United States Patent 12,508,308 (INFLUENZA mRNA VACCINES) - sequence listing, part 27

SEQ ID NO: 100605 - RNA, 1701 nt, Artificial Sequence
  derived and/or modified sequence opt2 from hemagglutinin__InfluenzaA__AFM71923
augaagaccaucaucgcccucuccuacaucuucugccucguccucggccaggaccuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcaacaacccccaccgcauccucgacggcaucgacugcacccucaucgacgcccuccucggcgacccccacugcgacuccuuccagaacgagaccugggaccucuucgucgagcgcuccaaggccuucuccaacugcuaccccuacgacguccccgacuacgccucccuccgcucccucgucgccuccuccggcacccucgaguucaucaacgagggcuucaccuggaccggcgucacccagaacggcggcuccaacgccugcaagcgcggccccgacuccggcuucuucucccgccucaacuggcucuacaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccaccaagcgcucccagcagaccaucauccccaacaucggcucccgccccuggguccgcggccucuccucccgcaucuccaucuacuggaccaucgucaagcccggcgacauccucgucaucaacuccaacggcaaccucaucgccccccgcggcuacuucaagaugcgcaccggcaaguccuccaucaugcgcuccgacgcccccaucggcaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuuccgcaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100606 - RNA, 1701 nt, Artificial Sequence
  derived and/or modified sequence opt2 from hemagglutinin__InfluenzaA__AFM71934
augaagaccaucaucgcccucuccuacaucuucugccucguccucggccaggaccuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcaacaacccccaccgcauccucgacggcaucgacugcacccucaucgacgcccuccucggcgacccccacugcgacggcuuccagaacgagaccugggaccucuucgucgagcgcuccaaggccuucuccaacugcuaccccuacgacguccccgacuacgccucccuccgcucccucgucgccuccuccggcacccucgaguucaucaacgagggcuucaccuggaccggcgucacccagaacggcggcuccaacgccugcaagcgcggccccgacuccggcuucuucucccgccucaacuggcucuacaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccaccaagggcucccagcagaccaucauccccaacaucggcucccgccccuggguccgcggccucuccucccgcaucuccaucuacuggaccaucgucaagcccggcgacauccucgucaucaacuccaacggcaaccucaucgccccccgcggcuacuucaagaugcgcaccggcaaguccuccaucaugcgcuccgacgcccccaucggcaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuuccgcaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100607 - RNA, 1701 nt, Artificial Sequence
  derived and/or modified sequence opt2 from hemagglutinin__InfluenzaA__AFM71945
augaagaccaucaucgcccucuccuacaucuucugccucguccucggccaggacuuccccggcaacgacaacuccaccgccacccucugccucggccaccacgccguccccaacggcacccucgucaagaccaucaccaacgaccagaucgaggucaccaacgccaccgagcucguccaguccuccuccaccggcaagaucugcaacaacccccaccgcauccucgacggcaucaacugcacccucaucgacgcccuccucggcgacccccacugcgacggcuuccagaacgagaccugggaccucuucgucgagcgcuccaaggccuucuccaacugcuaccccuacgacguccccgacuacgccucccuccgcucccucgucgccuccuccggcacccucgaguucaucaacgagggcuucaccuggaccggcgucacccagaacggcggcuccaacgccugcaagcgcggccccgacuccggcuucuucucccgccucaacuggcucuacaaguccggcuccgccuaccccguccucaacgucaccaugcccaacaacgacaacuucgacaagcucuacaucuggggcguccaccaccccuccaccgaccaggagcagaccaaccucuacguccaggccuccggccgcgucaccgucuccaccaagcgcucccagcagaccaucauccccaacaucggcucccgccccuggguccgcggccucuccucccgcaucuccaucuacuggaccaucgucaagcccggcgacauccucgucaucaacuccaacggcaaccucaucgccccccgcggcuacuucaagaugcgcaccggcaaguccuccaucaugcgcuccgacgcccccaucggcaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100608 - RNA, 1701 nt, Artificial Sequence; identical to SEQ ID NO: 100607
  derived and/or modified sequence opt2 from hemagglutinin__InfluenzaA__AFM71956

SEQ ID NO: 100609 - RNA, 1704 nt, Artificial Sequence
  derived and/or modified sequence opt2 from hemagglutinin__InfluenzaA__AFM71978
augaagaccaucaucgcccucuccuacaucuucugccucgucuucgcccaggaccuccccggcaacgacaacaacuccaccgccacccucugccucggccaccacgccguccccaacggcacccucgucaagaccaucaccaacgaccagaucgaggucaccaacgccaccgagcucguccaguccuccuccaccggcaagaucugcaacaacccccaccgcauccucgacggcaucaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccagaacggcggcuccaacgccugcaagcgcggccccgacuccggcuucuucucccgccucaacuggcucuacaaguccggcuccaccuaccccguccagaacgucaccaugcccaacaacgacaacuccgacaagcucuacaucuggggcguccaccaccccuccaccgacaaggagcagaccaaccucuacguccaggccuccggcaaggucaccgucuccaccaagcgcucccagcagaccaucauccccaacgucggcucccgccccuggguccgcggccucuccucccgcaucuccaucuacuggaccaucgucaagcccggcgacauccucgucaucaacuccaacggcaaccucaucgccccccgcggcuacuucaagaugcgcaccggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100610 - RNA, 1701 nt, Artificial Sequence
  derived and/or modified sequence opt2 from hemagglutinin__InfluenzaA__AFM71989
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccuccaccgacaaggaccagaucuuccucuacacccaggccgccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100611 - RNA, 1701 nt, Artificial Sequence
  derived and/or modified sequence opt2 from hemagglutinin__InfluenzaA__AFM72010
augaagaccaucaucgcccucuccuacaucuucugccagguccucgcccagaaccuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccagaacggcggcuccuacgccugcaagcgcggccccgacaaguccuucuucucccgccucaacuggcucuacgaguccgaguccaccuaccccguccucaacgucaccaugcccaacaacgacaacuucgacaagcucuacaucuggggcguccaccaccccuccaccgacaaggagcagaccaagcucuacguccaggccuccggccgcgucaccgucuccaccaagcgcucccagcagaccaucauccccaacgucggcucccgccccuggguccgcggccucuccucccgcaucuccaucuacuggaccaucgucaagcccggcgacauccuccucaucaacuccaacggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100612 - RNA, 1701 nt, Artificial Sequence; identical to SEQ ID NO: 92427
  derived and/or modified sequence opt2 from hemagglutinin__InfluenzaA__AFM72021

SEQ ID NO: 100613 - RNA, 1701 nt, Artificial Sequence
  derived and/or modified sequence opt2 from hemagglutinin__InfluenzaA__AFM72032
augaagaccaucaucgcccucuccuacauguucugccucgucuucgcccagaaccuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccaguccggcggcuccuacaccugcaagcgcggcuccaacaacuccuucuucucccgccucaacuggcucuacgaguccgaguccaaguaccccguccucaacgucaccaugcccaacaacggcaaguucgacaagcucuacaucuggggcauccaccaccccuccaccgacaaggagcagaccaaccucuacauccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100614 - RNA, 1701 nt, Artificial Sequence
  derived and/or modified sequence opt2 from hemagglutinin__InfluenzaA__AFM72043
augaagaccaucaucgcccucuccuacauguucugccucgucuucgcccagaaccuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccaguccggcggcuccuccaccugcaagcgcggcuccaacaacuccuucuucucccgccucaacuggcucuacgaguccgaguccaaguaccccguccucaacgucaccaugcccaacaacggcaaguucgacaagcucuacaucuggggcauccaccaccccuccaccgacaaggagcagaccaaccucuacauccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100615 - RNA, 1701 nt, Artificial Sequence
  derived and/or modified sequence opt2 from hemagglutinin__InfluenzaA__AFM72054
augaaggccaagcuccucguccuccucugcgcccucuccgccaccgacgccgacaccaucugcaucggcuaccacgccaacaacuccaccgacaccgucgacaccguccucgagaagaacgucaccgucacccacuccgucaaccuccucgaggacaaccacaacggcaagcucugcaagcucaagggcaucgccccccuccagcucggcaagugcuccaucgccggcuggauccucggcaaccccgagugcgagucccucuucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggaguccuccuggcccaagcacaacgucaccaagggcgucaccgccgccugcucccacaagggcaaguccuccuucuaccgcaaccuccucuggcucaccgagaagaacggcuccuaccccaaccucuccaaguccuacgucaacaacaaggagaaggagguccucguccucuggggcguccaccaccccuccaacaucgaggaccagaagaccaucuaccgcaaggagaacgccuacgucuccgucgucuccucccacuacaaccgccgcuucacccccgagaucgccaagcgccccaagguccgcaaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccaucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 100616 - RNA, 1701 nt, Artificial Sequence; identical to SEQ ID NO: 100615
  derived and/or modified sequence opt2 from hemagglutinin__InfluenzaA__AFM72065

SEQ ID NO: 100617 - RNA, 1701 nt, Artificial Sequence
  derived and/or modified sequence opt2 from hemagglutinin__InfluenzaA__AFM72087
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucaucgagcgcuccaaggccuucuccaacugcuaccccuacgacguccccgacuacgccucccuccgcucccucgucgccuccuccggcacccucgaguucaucaacgagggcuucaacuggaccggcgucacccaguccggcggcuccuacaccugcaagcgcggcuccgucaacuccuucuucucccgccucaacuggcucuacgaguccgaguacaaguaccccgcccucaacgucaccaugcccaacaacggcaaguucgacaagcucuacaucuggggcguccaccaccccuccaccgagaaggagcagaccaaccucuacguccgcgccuccggccgcgucaccgucuccaccaagcgcucccagcagaccgucauccccaacaucggcuccucccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccaguacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100618 - RNA, 1701 nt, Artificial Sequence
  derived and/or modified sequence opt2 from hemagglutinin__InfluenzaA__AFM72098
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucacccaguccggcggcuccuacgccugcaagcgcggcuccgucaacuccuucuucucccgccucaacuggcucuacaaguccgaguacaaguaccccgcccucaacgucaccaugcccaacaacggcaaguucgacaagcucuacaucuggggcguccaccaccccgucaccgaccgcgagcagaccaaccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100619 - RNA, 1701 nt, Artificial Sequence
  derived and/or modified sequence opt2 from hemagglutinin__InfluenzaA__AFM72109
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucacccaguccggcggcuccuacgccugcaagcgcggcuccgucaacuccuucuucucccgccucaacuggcuccacaaguccgaguacaaguaccccgcccucaacgucaccaugcccaacaacggcaaguucgacaagcucuacaucuggggcguccaccaccccaucaccgaccgcgagcagaccaaccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100620 - RNA, 1701 nt, Artificial Sequence
  derived and/or modified sequence opt2 from hemagglutinin__InfluenzaA__AFM72120
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucacccaguccggcggcuccuacgccugcaagcgcggcuccgucaacuccuucuucucccgccucaacuggcuccacgaguccgaguacaaguaccccgcccucaacgucaccaugcccaacaacggcaaguucgacaagcucuacaucuggggcguccaccaccccaucaccgaccgcgagcagaccaaccucuacguccgcgccuccggccgcgucaccgucuccaccaagcgcucccagcagaccgucauccccaacaucggcuuccgccccuggguccgcggccucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaccugcuccuccgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100621 - RNA, 1701 nt, Artificial Sequence
  derived and/or modified sequence opt2 from hemagglutinin__InfluenzaA__AFM72131
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaaggacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaacggcgucgcccaguccggcgaguccuacgccugcaagcgcggcuccgucaaguccuucuucucccgccucaacuggcuccacgaguccgaguacaaguaccccgcccucaacgucaccaugcccaacaacggcaaguucgacaagcucuacaucuggggcguccaccaccccuccaccgaccgcgagcagaccaagcucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100622 - RNA, 1701 nt, Artificial Sequence
  derived and/or modified sequence opt2 from hemagglutinin__InfluenzaA__AFM72142
augaagaccaucaucgcccucuccuacaucuccugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcggcuccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgaccgcgaccagaccucccucuacguccgcgccuccggccgcgucaccgucuccaccaagcgcucccagcagaccgucauccccaacaucggcucccgccccuggguccgcggccaguccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100623 - RNA, 1701 nt, Artificial Sequence
  derived and/or modified sequence opt2 from hemagglutinin__InfluenzaA__AFM72153
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcggcuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgaggacuucaacuggaccggcgucgcccaggacggcggcuccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucacccccaacaucggcucccgccccuggguccgcggccaguccucccgcaucggcaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100624 - RNA, 1701 nt, Artificial Sequence
  derived and/or modified sequence opt2 from hemagglutinin__InfluenzaA__AFM72164
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccucccccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgagaacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccucccucuacguccgcgccuccggccgcgucaccgucuccaccaagcgcucccagcagaccgucauccccgacaucggcuaccgccccuggguccgcggccaguccucccgcaucuccauccacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucgucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100625 - RNA, 1701 nt, Artificial Sequence
  derived and/or modified sequence opt2 from hemagglutinin__InfluenzaA__AFM72175
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccucccccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaucaacgagaacuucaacuggaccggcgucgcccaggacggcaaguccuacgccugcaagcgcggcuccgucaacuccuucuucucccgccucaacuggcuccacaagcucgaguacaaguaccccgcccucaacgucaccaugcccaacaacggcaaguucgacaagcucuacaucuggggcguccaccaccccuccaccgacuccgaccagaccaaccucuacguccgcgccuccggccgcgucaccgucuccaccaagcgcucccagcagaccgucauccccgacaucggcuaccgccccuggguccgcggccaguccucccgcaucuccauccacuggaccaucgucaagcccggcgacauccuccucaucaacuccaccggcaaccucaucgccccccgcggcuacuucaagauccgcaacggcaaguccuccaucaugcgcuccgacgcccccaucggcaacugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucgucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100626 - RNA, 1701 nt, Artificial Sequence
  derived and/or modified sequence opt2 from hemagglutinin__InfluenzaA__AFM72197
augaagaccaucaucgcccucuccuacauccucugcauggucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuacgccugcaagcgccgcuccgucaaguccuucuucucccgccucaacuggcuccacaagcucgaguacaaguaccccgcccucaacgucaccaugcccaacaacgacaaguucgacaagcucuacaucuggggcguccaccaccccaucaccgacuccgagcagaccucccucuacguccaggccuccggccgcgucaccgucuccaccaagcgcucccagcagaccgucauccccaacaucggcuaccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacaucaagugcaacaucugcaucuga

SEQ ID NO: 100627 - RNA, 1701 nt, Artificial Sequence
  derived and/or modified sequence opt2 from hemagglutinin__InfluenzaA__AFM72208
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaacuccuucuucucccgccucaacuggcuccaccagcucaaguaccgcuaccccgcccucaacgucaccaugcccaacaacgacaaguucgacaagcucuacaucuggggcguccaccaccccuccaccgacuccgaccagaccucccucuacacccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100628 - RNA, 1701 nt, Artificial Sequence
  derived and/or modified sequence opt2 from hemagglutinin__InfluenzaA__AFM72219
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaacuccuucuucucccgccucaacuggcuccaccagcucaaguaccgcuaccccgcccucaacgucaccaugcccaacaacgacaaguucgacaagcucuacaucuggggcguccaccaccccuccaccgacuccgaccagaccucccucuacacccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaaguccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100629 - RNA, 1698 nt, Artificial Sequence
  derived and/or modified sequence opt2 from hemagglutinin__InfluenzaA__AFM72230
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaagaaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgucaacaacaaggagaaggagguccucguccucuggggcguccaccacccccccaacaucggcaaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 100630 - RNA, 1701 nt, Artificial Sequence
  derived and/or modified sequence opt2 from hemagglutinin__InfluenzaA__AFM72246
augaagaccaucaucgcccucuccuacauccucugccucgucuucgcccagaagcuccccggcaacgacaacuccaccgccacccucugccucggccaccacgccgucuccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaacaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucuccaucuacgcccaggccuccggccgcgucaccgucuccaccaagcgcucccagcagaccgucauccccaacaucggcuccucccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100631 - RNA, 1701 nt, Artificial Sequence
  derived and/or modified sequence opt2 from hemagglutinin__InfluenzaA__AFM72257
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaacuacaaguaccccgcccucaacgucaccaugcccaacaacgagaaguucgacaagcucuacaucuggggcguccaccaccccuccaccgacuccgaccagaucuccaucuacgcccaggccuccggccgcgucaccgucuccaccaagcgcucccagcagaccgucauccccaacaucggcucccgccccuggguccgcggcgucuccuccggcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100632 - RNA, 1701 nt, Artificial Sequence
  derived and/or modified sequence opt2 from hemagglutinin__InfluenzaA__AFM72268
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaacuacaaguaccccgcccucaacgucaccaugcccaacaacgagaaguucgacaagcucuacaucuggggcguccaccaccccaacaccgacuccgaccagaucuccaucuacgcccaggccuccggccgcgucaccgucuccaccaagcgcucccagcagaccgucauccccaacaucggcucccgccccuggguccgcggcgucuccuccggcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100633 - RNA, 1701 nt, Artificial Sequence
  derived and/or modified sequence opt2 from hemagglutinin__InfluenzaA__AFM72279
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaguacaaguaccccgcccucaacgucaccaugcccaacaacgagaaguucgacaagcucuacaucuggggcguccaccaccccuccaccgacuccgaccagaucuccaucuacgcccaggccuccggccgcgucaccgucuccaccaagcgcucccagcagaccgucauccccaacaucggcuccaagcacuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100634 - RNA, 1701 nt, Artificial Sequence
  derived and/or modified sequence opt2 from hemagglutinin__InfluenzaA__AFM72290
augaagaccaucaucgcccucuccuacauccucugccucgucuucgcccagaagcuccccgucaacgacaacuccaccgccacccucugccucggccaccacgccguccccaacggcacccucgucaagaccaucaccaacgaccacaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaccgccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucaaggacaaguaccccgcccucaacgucaccaugcccaacaacgagaaguucgacaagcucuacaucuggggcguccaccaccccuccaccgacuccgaccagaucuccaucuacgcccaggccuccggccgcgucaccgucuccaccaagcgcucccagcagaccgucauccccaacaucggcuccaagcacuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100635 - RNA, 1701 nt, Artificial Sequence
  derived and/or modified sequence opt2 from hemagglutinin__InfluenzaA__AFM72301
augaagaccaucaucgcccucuccuacauccucugccucgucuucucccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcaagcgccgcuccaacaaguccuucuucucccgccucaacuggcucacccagcucaaguacaaguaccccgcccucaacgucaccaugcccaacaacgagaaguucgacaagcucuacaucuggggcguccaccaccccgucaccgacuccgaccagaucucccucuacgcccaggccuccggccgcaucaccgucuccaccaagcgcucccagcagaccgucauccccaacaucggcuaccgcccccgcguccgcgacaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100636 - RNA, 1701 nt, Artificial Sequence
  derived and/or modified sequence opt2 from hemagglutinin__InfluenzaA__AFM72312
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccgucaccgacuccgaccagaucaaccucuacgcccaggccuccggccgcaucaccgucuccaccaagcgcucccagcagaccgucauccccaacaucggcuaccgcccccgcguccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100637 - RNA, 1701 nt, Artificial Sequence
  derived and/or modified sequence opt2 from hemagglutinin__InfluenzaA__AFM72323
augaaggccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccgucaccgacuccgaccagaucaaccucuacgcccaggccuccggccgcaucaccgucuccaccaagcgcucccagcagaccgucauccccaacaucggcuaccgcccccgcguccgcgacaaccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100638 - RNA, 1701 nt, Artificial Sequence
  derived and/or modified sequence opt2 from hemagglutinin__InfluenzaA__AFM72334
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccuccaccccggcaccuacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100639 - RNA, 1701 nt, Artificial Sequence
  derived and/or modified sequence opt2 from hemagglutinin__InfluenzaA__AFM72345
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucgacuggaccggcgucacccagaacggcaccuccuccgccugcaagcgccgcuccaacaaguccuucuucucccgccucaacuggcucacccaccucaaguacaaguaccccgcccucaacgucaccaugcccaacaacgagaaguucgacaagcucuacaucuggggcguccaccaccccgucaccgacuccgaccagaucucccucuacacccaggccuccggccgcaucaccgucuccaccaagcgcucccagcagaccgucauccccaacaucggcuuccgcccccgcguccgcgacaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100640 - RNA, 1701 nt, Artificial Sequence
  derived and/or modified sequence opt2 from hemagglutinin__InfluenzaA__AFM72356
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucaaccucuacguccaggccuccggccgcaucaccgucuccaccaagcgcucccagcagaccgucauccccaacaucggcucccgcccccgcguccgcgacguccccucccgcaucuccaucuacuggaccaucgucaagcccggcgacauccuccucaucuccuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100641 - RNA, 1701 nt, Artificial Sequence
  derived and/or modified sequence opt2 from hemagglutinin__InfluenzaA__AFM72367
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaaguccuucuucucccgccucaacuggcucacccaccucaaguucaaguaccccgcccucaacgucaccaugcccaacaacgagaaguucgacaagcucuacaucuggggcguccaccaccccgucaccgacaacgaccagaucaaccucuacgcccaggccuccggccgcaucaccgucuccaccaagcgcucccagcagaccgucauccccaacaucggcucccgcccccgcguccgcgacguccccucccgcaucuccaucuacuggaccaucgucaagcccggcgacauccuccucaucuccuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100642 - RNA, 1701 nt, Artificial Sequence
  derived and/or modified sequence opt2 from hemagglutinin__InfluenzaA__AFM72378
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccagcucaacuucaaguaccccgcccucaacgucaccaugcccaacaacgagcaguucgacaagcucuacaucuggggcguccaccaccccgucaccgacaaggaccagaucuuccucuacgcccaggccuccggccgcaucaccgucuccaccaagcgcucccagcaggccgucauccccaacaucggcuaccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100643 - RNA, 1701 nt, Artificial Sequence
  derived and/or modified sequence opt2 from hemagglutinin__InfluenzaA__AFM72389
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccgucaccgacaaggaccagaucuuccucuacgcccaggccuccggccgcaucaccgucuccaccaagcgcucccagcaggccgucauccccaacaucggcuaccgcccccgcguccgcaacaaccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100644 - RNA, 1701 nt, Artificial Sequence
  derived and/or modified sequence opt2 from hemagglutinin__InfluenzaA__AFM72400
augaagaccaucaucgcccucuccuacauccucugccucgucuucgcccagaagcuccccggcaucgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcaagcgcggcuccaacaacuccuucuucucccgccucaacuggcucacccacuccaaguucaaguaccccgcccucaacgucaccaugcccaacaacgaggaguucgacaagcucuacaucuggggcguccuccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100645 - RNA, 1701 nt, Artificial Sequence
  derived and/or modified sequence opt2 from hemagglutinin__InfluenzaA__AFM72411
augaagaccaucaucgcccucuccuacauccucugccucgucuucgcccagaagcuccccggcaucgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcaagcgcggcuccaacaacuccuucuucucccgccucaacuggcucacccaguccaaguucaaguaccccgcccucaacgucaccaugcccaacaacgaggaguucgacaagcucuacaucuggggcguccaccaccccgucaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggacuucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100646 - RNA, 1701 nt, Artificial Sequence
  derived and/or modified sequence opt2 from hemagglutinin__InfluenzaA__AFM72422
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgaggaguucgacaagcucuacaucuggggcguccaccaccccgucaccgacaacgaccagaucuuccucuacgcccaggccuccggccgcaucaccgucuccaccaagcgcucccagcagaccgucauccccaacaucggcuuccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgccgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100647 - RNA, 1701 nt, Artificial Sequence
  derived and/or modified sequence opt2 from hemagglutinin__InfluenzaA__AFM72433
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgaggaguucgacaagcucuacaucuggggcguccaccaccccgucaccgacaacgaccagaucuuccucuacgcccaggccuccggccgcaucaccgucuccaccaagcgcucccagcagaccgucauccccaacaucggcuuccgcccccgcguccgcaacaaccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgccgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100648 - RNA, 1701 nt, Artificial Sequence
  derived and/or modified sequence opt2 from hemagglutinin__InfluenzaA__AFM72444
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgaggaguucgacaagcucuacaucuggggcguccaccaccccgucaccgacaacgaccagauccuccucuacgcccaggccuccggccgcaucaccgucuccaccaagcgcucccagcagaccgucauccccaacaucggcuuccgcccccgcguccgcaacaaccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgccgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100649 - RNA, 1701 nt, Artificial Sequence
  derived and/or modified sequence opt2 from hemagglutinin__InfluenzaA__AFM72455
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccagcucaaguucaaguaccccgcccucaacgucaccaugcccaacaacgaggaguucgacaagcucuacaucuggggcguccaccaccccgucaccgacaacgaccagaucuuccucuacgcccaggccuccggccgcaucaccgucuccaccaagcgcucccagcagaccgucauccccaacaucggcuuccgcccccgcguccgcaacaaccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgccgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100650 - RNA, 1701 nt, Artificial Sequence
  derived and/or modified sequence opt2 from hemagglutinin__InfluenzaA__AFM72466
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgaggaguucgacaagcucuacaucuggggcguccaccaccccgucaccgacaaggaccagaucuuccucuacgcccaggccuccggccgcaucaccgucuccaccaagcgcucccagcagaccgucauccccaacaucggcuuccgcccccgcguccgcaacaaccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgccgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100651 - RNA, 1701 nt, Artificial Sequence
  derived and/or modified sequence opt2 from hemagglutinin__InfluenzaA__AFM72488
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccagcucaaguucaaguaccccgcccucaacgucaccaugcccaacaacgagaaguucgacaagcucuacaucuggggcguccaccaccccgucaccgacaacgagcagaucuuccucuacgcccaggccuccggccgcaucaccgucuccaccaagcgcucccagcagaccgucauccccaacaucggcuuccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccaagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100652 - RNA, 1701 nt, Artificial Sequence
  derived and/or modified sequence opt2 from hemagglutinin__InfluenzaA__AFM72499
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccagcucaaguucaaguaccccgcccucaacgucaccaugcccaacaacgagaaguucgacaagcucuacaucuggggcguccaccaccccgucaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100653 - RNA, 1698 nt, Artificial Sequence
  derived and/or modified sequence opt2 from hemagglutinin__InfluenzaA__AFM72521
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggccgccucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccucccucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcaaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 100654 - RNA, 1698 nt, Artificial Sequence; identical to SEQ ID NO: 100653
  derived and/or modified sequence opt2 from hemagglutinin__InfluenzaA__AFM72532

SEQ ID NO: 100655 - RNA, 1698 nt, Artificial Sequence; identical to SEQ ID NO: 100653
  derived and/or modified sequence opt2 from hemagglutinin__InfluenzaA__AFM72543

SEQ ID NO: 100656 - RNA, 1698 nt, Artificial Sequence
  derived and/or modified sequence opt2 from hemagglutinin__InfluenzaA__AFM72554
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggccgccucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccucccucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcaaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacgaggucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 100657 - RNA, 1701 nt, Artificial Sequence
  derived and/or modified sequence opt2 from hemagglutinin__InfluenzaA__AFM72565
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccuccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccccuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100658 - RNA, 1701 nt, Artificial Sequence
  derived and/or modified sequence opt2 from hemagglutinin__InfluenzaA__AFM72576
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccuccugcauccgcggcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccccuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100659 - RNA, 1698 nt, Artificial Sequence
  derived and/or modified sequence opt2 from hemagglutinin__InfluenzaA__AFM72799
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacaaccacaacggcaagcucugccuccucaagggcaaggccccccuccagcucggcaacugcuccgucgccggcuggauccucggcaaccccgagugcggccuccucaucuccaaggaguccugguccuacaucgucgagcgccccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuacaagaaccuccucuggcucaccggcaagaacggccucuaccccaaccucuccaaguccuacgccaacaacaaggagaaggagguccucguccucuggggcguccaccacccccccaacaucggcaaccagaugacccucuaccacaaggagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacgucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacgacgagugcauggaguccgucaagaacggcaccuacgacuaccccaaguacuccgaggaguccaagcucucccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 100660 - RNA, 1698 nt, Artificial Sequence; identical to SEQ ID NO: 100659
  derived and/or modified sequence opt2 from hemagglutinin__InfluenzaA__AFM72810

SEQ ID NO: 100661 - RNA, 1698 nt, Artificial Sequence; identical to SEQ ID NO: 100659
  derived and/or modified sequence opt2 from hemagglutinin__InfluenzaA__AFM72821

SEQ ID NO: 100662 - RNA, 1701 nt, Artificial Sequence
  derived and/or modified sequence opt2 from hemagglutinin__InfluenzaA__AFM72852
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagacccccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccgacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaccuucaagcccgagaucgccauccgccccaagguccgcgaccgcgagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100663 - RNA, 1701 nt, Artificial Sequence
  derived and/or modified sequence opt2 from hemagglutinin__InfluenzaA__AFM72862
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagacccccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaacuccuacaucaacgacaagggcaaggagguccucguccucuggggcauccaccaccccuccaccuccgccgaccagcagucccucuaccagaacgccgacgccuacgucuucgucggcuccucccgcuacuccaagaccuucaagcccgagaucgccauccgccccaagguccgcgaccgcgagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100664 - RNA, 1701 nt, Artificial Sequence
  derived and/or modified sequence opt2 from hemagglutinin__InfluenzaA__AFM72872
augaagaccaucaucgcccucuccuacacccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccccuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100665 - RNA, 1701 nt, Artificial Sequence
  derived and/or modified sequence opt2 from hemagglutinin__InfluenzaA__AFM72883
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccgucaccgacaaggaccagaucuuccucuacgcccaggccuccggccgcaucaccgucuccaccaagcgcucccagcagaccgucauccccaacaucggcucccgcccccgcguccgcaacauccccacccgcaucuccaucuacuggaccaucgucaagcccggcgacauccuccucaucaacuccaccggcaaccucaucgccccccgcggcuacuucaagaugcaguccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100666 - RNA, 1701 nt, Artificial Sequence
  derived and/or modified sequence opt2 from hemagglutinin__InfluenzaA__AFM72894
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccagcucaacuucaaguaccccgcccucaacgucaccaugcccaacaacgagcaguucgacaagcucuacaucuggggcguccaccaccccgucaccgacaaggaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagaugcaguccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100667 - RNA, 1701 nt, Artificial Sequence
  derived and/or modified sequence opt2 from hemagglutinin__InfluenzaA__AFM72916
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccccuacgcccaggccuccggccgcaucaccgucuccaccaagcgcucccagcagaccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccggcugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacugguuccucuggaucuccuucgccaucuccugcuuccuccucugcgucgcccuccucggcuucaucaugugggccugccagaagggcaacauccgcugcaacaucugcaucuga

SEQ ID NO: 100668 - RNA, 1701 nt, Artificial Sequence
  derived and/or modified sequence opt2 from hemagglutinin__InfluenzaA__AFM72927
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaccucccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaucggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100669 - RNA, 1701 nt, Artificial Sequence
  derived and/or modified sequence opt2 from hemagglutinin__InfluenzaA__AFM72938
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaccucccucuacgcccaggccuccggccgcaucaccgucuccaccaagcgcucccagcagaccgucauccccaacaucggcucccgcccccgcguccgcaacaaccccucccgcaucuccaucuacuggaccaucgucaagcccggcgacauccuccucaucaacuccaucggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100670 - RNA, 1701 nt, Artificial Sequence
  derived and/or modified sequence opt2 from hemagglutinin__InfluenzaA__AFM72949
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccagcucaaguucaaguaccccgcccucaacgucaccaugcccaacaacgagcaguucgacaagcucuacaucuggggcguccaccaccccggcaccgacaacgaccagaccucccucuacgcccaggccuccggccgcaucaccgucuccaccaagcgcucccagcagaccgucauccccaacaucggcucccgcccccgcguccgcaacaaccccucccgcaucuccaucuacuggaccaucgucaagcccggcgacauccuccucaucaacuccaucggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100671 - RNA, 1701 nt, Artificial Sequence
  derived and/or modified sequence opt2 from hemagglutinin__InfluenzaA__AFM72960
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaaguggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaccucccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaucggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100672 - RNA, 1701 nt, Artificial Sequence
  derived and/or modified sequence opt2 from hemagglutinin__InfluenzaA__AFM72971
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaaguggaccggcgucacccagaacggcaccuccuccgccugcauccgccgcuccaacaacuccuucuucucccgccucaacuggcucacccagcucaacuucaaguaccccgcccucaacgucaccaugcccaacaacgagcaguucgacaagcucuacaucuggggcguccaccaccccggcaccgacaacgaccagaccucccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaucggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100673 - RNA, 1701 nt, Artificial Sequence
  derived and/or modified sequence opt2 from hemagglutinin__InfluenzaA__AFM72982
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacuccgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccccuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacaucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucucccucgccaucuccugcuuccuccucugcgucgcccuccucggcuucaucaugugggccugccagaagggcaacauccgcugcaacaucugcaucuga

SEQ ID NO: 100674 - RNA, 1701 nt, Artificial Sequence
  derived and/or modified sequence opt2 from hemagglutinin__InfluenzaA__AFM72993
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccgccggcgagaucugcgacuccccccaccagauccucgacggcgagaacugcacccucaucgacgcccuccucggcgacccccagugcgacggcuuccagaacaagaagugggaccucuucgucgagcgcucccgcgccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccuccaccccggcaccuacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100675 - RNA, 1701 nt, Artificial Sequence
  derived and/or modified sequence opt2 from hemagglutinin__InfluenzaA__AFM73004
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccgccggcgagaucugcgacuccccccaccagauccucgacggcgagaacugcacccucaucgacgcccuccucggcgacccccagugcgacggcuuccagaacaagaagugggaccucuucgucgagcgcucccgcgccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccuccaccccggcaccuacaaggaccagaucuuccucuacgcccaggccuccggccgcgucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuucuuccucugcgucgcccuccucggcuucaucaugugggccugccagaagggcaacauccgcugcaacaucugcaucuga

SEQ ID NO: 100676 - RNA, 1701 nt, Artificial Sequence
  derived and/or modified sequence opt2 from hemagglutinin__InfluenzaA__AFM73015
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccgcgagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100677 - RNA, 1701 nt, Artificial Sequence
  derived and/or modified sequence opt2 from hemagglutinin__InfluenzaA__AFM73025
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgacgaccagcagucccucuaccagaacgccgacaccuacgucuucgucggcaccucccgcuacuccaagaaguucaagcccgagaucgccauccgccccaagguccgcgaccgcgagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100678 - RNA, 1701 nt, Artificial Sequence; identical to SEQ ID NO: 100677
  derived and/or modified sequence opt2 from hemagglutinin__InfluenzaA__AFM73035

SEQ ID NO: 100679 - RNA, 1701 nt, Artificial Sequence
  derived and/or modified sequence opt2 from hemagglutinin__InfluenzaA__AFM73045
augaaggccauccucgucguccuccucuacaccuucgccaccgccaacgccgacacccucugcaucggcuaccacgccaacaacuccaccgacaccgucgacaccguccucgagcgcaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaguccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100680 - RNA, 1701 nt, Artificial Sequence
  derived and/or modified sequence opt2 from hemagglutinin__InfluenzaA__AFM73055
augaaggccauccucgucguccuccucuacaccuucgccaccgccaacgccgacacccucugcaucggcuaccacgccaacaacuccaccgacaccgucgacaccguccucgagcgcaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucgagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccgcgagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100681 - RNA, 1701 nt, Artificial Sequence
  derived and/or modified sequence opt2 from hemagglutinin__InfluenzaA__AFM73065
augaaggccauccucgucguccuccucuacaccuucgccaccgccaacgccgacacccucugcaucggcuaccacgccaacaacuccaccgacaccgucgacaccguccucgagcgcaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaaggagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccgcgagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100682 - RNA, 1701 nt, Artificial Sequence; identical to SEQ ID NO: 92427
  derived and/or modified sequence opt2 from hemagglutinin__InfluenzaA__AFM73477

SEQ ID NO: 100683 - RNA, 1707 nt, Artificial Sequence
  derived and/or modified sequence opt2 from hemagglutinin__InfluenzaA__AFM78567
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccaccaacgaccucugcuaccccggcuccuucaacgacuacgaggagcucaagcaccuccucucccgcaucaaccacuucgagaagauccagaucauccccaaguccuccugguccgaccacgaggccuccuccggcgucuccuccgccugccccuaccucggcucccccuccuucuuccgcaacgucgucuggcucaucaagaagaacuccaccuaccccaccaucaagaaguccuacaacaacaccaaccaggaggaccuccucguccucuggggcauccaccaccccaacgacgccgccgagcagacccgccucuaccagaaccccaccaccuacaucuccaucggcaccuccacccucaaccagcgccucguccccaagaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccgccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagucccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccauccgcaacggcaccuacaacuacccccaguacuccgaggaggcccgccucaagcgcgaggagaucuccggcgucaagcucgaguccaucggcaccuaccagauccucuccaucuacuccaccgucgccuccucccucgcccucgccaucaugauggccggccucucccucuggaugugcuccaacggcucccuccagugccgcaucugcaucuga

SEQ ID NO: 100684 - RNA, 1701 nt, Artificial Sequence
  derived and/or modified sequence opt2 from hemagglutinin__InfluenzaA__AFM78646
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagggccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100685 - RNA, 1698 nt, Artificial Sequence
  derived and/or modified sequence opt2 from hemagglutinin__InfluenzaA__AFM85179
augaaggucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucauccucuggggcguccaccacccccccaacaucggcgaccagcgcacccucuacuacaccgagaacgccuacgucuccgucgucuccucccacuacucccgccgcuucacccccgagaucaccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaucuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaaguucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 100686 - RNA, 1701 nt, Artificial Sequence
  derived and/or modified sequence opt2 from hemagglutinin__InfluenzaA__AFN11846
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaccaacgagggcuucaacuggaccggcgucgcccaggacggcaaguccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100687 - RNA, 1701 nt, Artificial Sequence; identical to SEQ ID NO: 95042
  derived and/or modified sequence opt2 from hemagglutinin__InfluenzaA__AFN17371

SEQ ID NO: 100688 - RNA, 1701 nt, Artificial Sequence; identical to SEQ ID NO: 94181
  derived and/or modified sequence opt2 from hemagglutinin__InfluenzaA__AFN17381

SEQ ID NO: 100689 - RNA, 1701 nt, Artificial Sequence; identical to SEQ ID NO: 94181
  derived and/or modified sequence opt2 from hemagglutinin__InfluenzaA__AFN17391

SEQ ID NO: 100690 - RNA, 1701 nt, Artificial Sequence; identical to SEQ ID NO: 94181
  derived and/or modified sequence opt2 from hemagglutinin__InfluenzaA__AFN17401

SEQ ID NO: 100691 - RNA, 1701 nt, Artificial Sequence; identical to SEQ ID NO: 94181
  derived and/or modified sequence opt2 from hemagglutinin__InfluenzaA__AFN17411

SEQ ID NO: 100692 - RNA, 1701 nt, Artificial Sequence; identical to SEQ ID NO: 94181
  derived and/or modified sequence opt2 from hemagglutinin__InfluenzaA__AFN17421

SEQ ID NO: 100693 - RNA, 1701 nt, Artificial Sequence; identical to SEQ ID NO: 94272
  derived and/or modified sequence opt2 from hemagglutinin__InfluenzaA__AFN17431

SEQ ID NO: 100694 - RNA, 1701 nt, Artificial Sequence
  derived and/or modified sequence opt2 from hemagglutinin__InfluenzaA__AFN17441
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaaggccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100695 - RNA, 1701 nt, Artificial Sequence; identical to SEQ ID NO: 96736
  derived and/or modified sequence opt2 from hemagglutinin__InfluenzaA__AFN17451

SEQ ID NO: 100696 - RNA, 1701 nt, Artificial Sequence; identical to SEQ ID NO: 95023
  derived and/or modified sequence opt2 from hemagglutinin__InfluenzaA__AFN17467

SEQ ID NO: 100697 - RNA, 1701 nt, Artificial Sequence; identical to SEQ ID NO: 94181
  derived and/or modified sequence opt2 from hemagglutinin__InfluenzaA__AFN17477

SEQ ID NO: 100698 - RNA, 1701 nt, Artificial Sequence; identical to SEQ ID NO: 95042
  derived and/or modified sequence opt2 from hemagglutinin__InfluenzaA__AFN17487

SEQ ID NO: 100699 - RNA, 1701 nt, Artificial Sequence; identical to SEQ ID NO: 94181
  derived and/or modified sequence opt2 from hemagglutinin__InfluenzaA__AFN17497

SEQ ID NO: 100700 - RNA, 1701 nt, Artificial Sequence; identical to SEQ ID NO: 94181
  derived and/or modified sequence opt2 from hemagglutinin__InfluenzaA__AFN17507

SEQ ID NO: 100701 - RNA, 1701 nt, Artificial Sequence; identical to SEQ ID NO: 95023
  derived and/or modified sequence opt2 from hemagglutinin__InfluenzaA__AFN17517

SEQ ID NO: 100702 - RNA, 1701 nt, Artificial Sequence; identical to SEQ ID NO: 95042
  derived and/or modified sequence opt2 from hemagglutinin__InfluenzaA__AFN17527

SEQ ID NO: 100703 - RNA, 1701 nt, Artificial Sequence; identical to SEQ ID NO: 94181
  derived and/or modified sequence opt2 from hemagglutinin__InfluenzaA__AFN17537

SEQ ID NO: 100704 - RNA, 1701 nt, Artificial Sequence; identical to SEQ ID NO: 94423
  derived and/or modified sequence opt2 from hemagglutinin__InfluenzaA__AFN17547

SEQ ID NO: 100705 - RNA, 1701 nt, Artificial Sequence; identical to SEQ ID NO: 95712
  derived and/or modified sequence opt2 from hemagglutinin__InfluenzaA__AFN17557

SEQ ID NO: 100706 - RNA, 1701 nt, Artificial Sequence; identical to SEQ ID NO: 95023
  derived and/or modified sequence opt2 from hemagglutinin__InfluenzaA__AFN17567

SEQ ID NO: 100707 - RNA, 1701 nt, Artificial Sequence; identical to SEQ ID NO: 94423
  derived and/or modified sequence opt2 from hemagglutinin__InfluenzaA__AFN17574

SEQ ID NO: 100708 - RNA, 1701 nt, Artificial Sequence; identical to SEQ ID NO: 94181
  derived and/or modified sequence opt2 from hemagglutinin__InfluenzaA__AFN17580

SEQ ID NO: 100709 - RNA, 1701 nt, Artificial Sequence; identical to SEQ ID NO: 94181
  derived and/or modified sequence opt2 from hemagglutinin__InfluenzaA__AFN17586

SEQ ID NO: 100710 - RNA, 1701 nt, Artificial Sequence; identical to SEQ ID NO: 95042
  derived and/or modified sequence opt2 from hemagglutinin__InfluenzaA__AFN17595

SEQ ID NO: 100711 - RNA, 1701 nt, Artificial Sequence; identical to SEQ ID NO: 94181
  derived and/or modified sequence opt2 from hemagglutinin__InfluenzaA__AFN17605

SEQ ID NO: 100712 - RNA, 1701 nt, Artificial Sequence; identical to SEQ ID NO: 94181
  derived and/or modified sequence opt2 from hemagglutinin__InfluenzaA__AFN17615

SEQ ID NO: 100713 - RNA, 1701 nt, Artificial Sequence; identical to SEQ ID NO: 94181
  derived and/or modified sequence opt2 from hemagglutinin__InfluenzaA__AFN17625

SEQ ID NO: 100714 - RNA, 1701 nt, Artificial Sequence; identical to SEQ ID NO: 94181
  derived and/or modified sequence opt2 from hemagglutinin__InfluenzaA__AFN17635

SEQ ID NO: 100715 - RNA, 1701 nt, Artificial Sequence
  derived and/or modified sequence opt2 from hemagglutinin__InfluenzaA__AFN17645
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcgucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100716 - RNA, 1701 nt, Artificial Sequence; identical to SEQ ID NO: 95042
  derived and/or modified sequence opt2 from hemagglutinin__InfluenzaA__AFN17655

SEQ ID NO: 100717 - RNA, 1701 nt, Artificial Sequence; identical to SEQ ID NO: 95042
  derived and/or modified sequence opt2 from hemagglutinin__InfluenzaA__AFN17665

SEQ ID NO: 100718 - RNA, 1701 nt, Artificial Sequence
  derived and/or modified sequence opt2 from hemagglutinin__InfluenzaA__AFN17675
augaaggccauccucaucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccgaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100719 - RNA, 1701 nt, Artificial Sequence
  derived and/or modified sequence opt2 from hemagglutinin__InfluenzaA__AFN17685
augaaggccauccucgucguccuccucuacaccuucgccaccgccaacgccgacacccucugcaucggcuaccacgccaacaacuccaccgacaccgucgacaccauccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagccccgcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100720 - RNA, 1701 nt, Artificial Sequence; identical to SEQ ID NO: 94181
  derived and/or modified sequence opt2 from hemagglutinin__InfluenzaA__AFN17695

SEQ ID NO: 100721 - RNA, 1701 nt, Artificial Sequence; identical to SEQ ID NO: 94181
  derived and/or modified sequence opt2 from hemagglutinin__InfluenzaA__AFN17705

SEQ ID NO: 100722 - RNA, 1701 nt, Artificial Sequence; identical to SEQ ID NO: 94810
  derived and/or modified sequence opt2 from hemagglutinin__InfluenzaA__AFN17715

SEQ ID NO: 100723 - RNA, 1701 nt, Artificial Sequence
  derived and/or modified sequence opt2 from hemagglutinin__InfluenzaA__AFN17725
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgcccccagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100724 - RNA, 1701 nt, Artificial Sequence; identical to SEQ ID NO: 94181
  derived and/or modified sequence opt2 from hemagglutinin__InfluenzaA__AFN17735

SEQ ID NO: 100725 - RNA, 1701 nt, Artificial Sequence; identical to SEQ ID NO: 94181
  derived and/or modified sequence opt2 from hemagglutinin__InfluenzaA__AFN17742

SEQ ID NO: 100726 - RNA, 1701 nt, Artificial Sequence; identical to SEQ ID NO: 94181
  derived and/or modified sequence opt2 from hemagglutinin__InfluenzaA__AFN17748

SEQ ID NO: 100727 - RNA, 1701 nt, Artificial Sequence; identical to SEQ ID NO: 94181
  derived and/or modified sequence opt2 from hemagglutinin__InfluenzaA__AFN17757

SEQ ID NO: 100728 - RNA, 1701 nt, Artificial Sequence; identical to SEQ ID NO: 94810
  derived and/or modified sequence opt2 from hemagglutinin__InfluenzaA__AFN17767

SEQ ID NO: 100729 - RNA, 1701 nt, Artificial Sequence; identical to SEQ ID NO: 99191
  derived and/or modified sequence opt2 from hemagglutinin__InfluenzaA__AFN17774

SEQ ID NO: 100730 - RNA, 1701 nt, Artificial Sequence; identical to SEQ ID NO: 94181
  derived and/or modified sequence opt2 from hemagglutinin__InfluenzaA__AFN17783

SEQ ID NO: 100731 - RNA, 1701 nt, Artificial Sequence; identical to SEQ ID NO: 94810
  derived and/or modified sequence opt2 from hemagglutinin__InfluenzaA__AFN17793

SEQ ID NO: 100732 - RNA, 1701 nt, Artificial Sequence; identical to SEQ ID NO: 94181
  derived and/or modified sequence opt2 from hemagglutinin__InfluenzaA__AFN17803

SEQ ID NO: 100733 - RNA, 1701 nt, Artificial Sequence; identical to SEQ ID NO: 94181
  derived and/or modified sequence opt2 from hemagglutinin__InfluenzaA__AFN17813

SEQ ID NO: 100734 - RNA, 1701 nt, Artificial Sequence
  derived and/or modified sequence opt2 from hemagglutinin__InfluenzaA__AFN17823
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccgaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100735 - RNA, 1701 nt, Artificial Sequence
  derived and/or modified sequence opt2 from hemagglutinin__InfluenzaA__AFN17833
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugccccaacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100736 - RNA, 1701 nt, Artificial Sequence; identical to SEQ ID NO: 98690
  derived and/or modified sequence opt2 from hemagglutinin__InfluenzaA__AFN17843

SEQ ID NO: 100737 - RNA, 1701 nt, Artificial Sequence; identical to SEQ ID NO: 94181
  derived and/or modified sequence opt2 from hemagglutinin__InfluenzaA__AFN17853

SEQ ID NO: 100738 - RNA, 1701 nt, Artificial Sequence; identical to SEQ ID NO: 94423
  derived and/or modified sequence opt2 from hemagglutinin__InfluenzaA__AFN17863

SEQ ID NO: 100739 - RNA, 1701 nt, Artificial Sequence
  derived and/or modified sequence opt2 from hemagglutinin__InfluenzaA__AFN17873
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccggcuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccucaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100740 - RNA, 1701 nt, Artificial Sequence
  derived and/or modified sequence opt2 from hemagglutinin__InfluenzaA__AFN17883
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccucaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100741 - RNA, 1701 nt, Artificial Sequence; identical to SEQ ID NO: 94181
  derived and/or modified sequence opt2 from hemagglutinin__InfluenzaA__AFN17893

SEQ ID NO: 100742 - RNA, 1701 nt, Artificial Sequence
  derived and/or modified sequence opt2 from hemagglutinin__InfluenzaA__AFN17903
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaguccaacaagggcgucaccgccgccugcccccacgccggcgccaaguccuucuacaagaaccucaucuggcucgucaagaagggcaacuccuaccccaagcucuccaaguccuacgucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100743 - RNA, 1701 nt, Artificial Sequence; identical to SEQ ID NO: 94534
  derived and/or modified sequence opt2 from hemagglutinin__InfluenzaA__AFN17919

SEQ ID NO: 100744 - RNA, 1701 nt, Artificial Sequence; identical to SEQ ID NO: 94423
  derived and/or modified sequence opt2 from hemagglutinin__InfluenzaA__AFN17929

SEQ ID NO: 100745 - RNA, 1701 nt, Artificial Sequence; identical to SEQ ID NO: 100439
  derived and/or modified sequence opt2 from hemagglutinin__InfluenzaA__AFN17939

SEQ ID NO: 100746 - RNA, 1701 nt, Artificial Sequence; identical to SEQ ID NO: 95042
  derived and/or modified sequence opt2 from hemagglutinin__InfluenzaA__AFN17949

SEQ ID NO: 100747 - RNA, 1701 nt, Artificial Sequence
  derived and/or modified sequence opt2 from hemagglutinin__InfluenzaA__AFN17959
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacgucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100748 - RNA, 1701 nt, Artificial Sequence; identical to SEQ ID NO: 95863
  derived and/or modified sequence opt2 from hemagglutinin__InfluenzaA__AFN17969

SEQ ID NO: 100749 - RNA, 1701 nt, Artificial Sequence; identical to SEQ ID NO: 95042
  derived and/or modified sequence opt2 from hemagglutinin__InfluenzaA__AFN17979

SEQ ID NO: 100750 - RNA, 1701 nt, Artificial Sequence
  derived and/or modified sequence opt2 from hemagglutinin__InfluenzaA__AFN17989
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucggcaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100751 - RNA, 1701 nt, Artificial Sequence; identical to SEQ ID NO: 94181
  derived and/or modified sequence opt2 from hemagglutinin__InfluenzaA__AFN17999

SEQ ID NO: 100752 - RNA, 1701 nt, Artificial Sequence
  derived and/or modified sequence opt2 from hemagglutinin__InfluenzaA__AFN18019
augaaggccauccucgucguccuccucuacaccuucgccaccgccaaggccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagauguuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100753 - RNA, 1701 nt, Artificial Sequence; identical to SEQ ID NO: 95042
  derived and/or modified sequence opt2 from hemagglutinin__InfluenzaA__AFN18039

SEQ ID NO: 100754 - RNA, 1701 nt, Artificial Sequence; identical to SEQ ID NO: 94181
  derived and/or modified sequence opt2 from hemagglutinin__InfluenzaA__AFN18049

SEQ ID NO: 100755 - RNA, 1701 nt, Artificial Sequence
  derived and/or modified sequence opt2 from hemagglutinin__InfluenzaA__AFN18059
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacgccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100756 - RNA, 1701 nt, Artificial Sequence; identical to SEQ ID NO: 94181
  derived and/or modified sequence opt2 from hemagglutinin__InfluenzaA__AFN18078

SEQ ID NO: 100757 - RNA, 1701 nt, Artificial Sequence
  derived and/or modified sequence opt2 from hemagglutinin__InfluenzaA__AFN18088
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccaugguccgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100758 - RNA, 1701 nt, Artificial Sequence
  derived and/or modified sequence opt2 from hemagglutinin__InfluenzaA__AFN18098
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcaucgccccccuccaccucggcaagugcaacaucgccggcuggauccucggcaaccccgagugcgagucccucuccaccgccuccuccugguccuacaucgucgagaccuccuccuccgacaacggcaccugcuaccccggcaacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccgucgagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100759 - RNA, 1701 nt, Artificial Sequence
  derived and/or modified sequence opt2 from hemagglutinin__InfluenzaA__AFN18105
augaaggccauccucaucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaacugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100760 - RNA, 1701 nt, Artificial Sequence; identical to SEQ ID NO: 94423
  derived and/or modified sequence opt2 from hemagglutinin__InfluenzaA__AFN18107

SEQ ID NO: 100761 - RNA, 1701 nt, Artificial Sequence; identical to SEQ ID NO: 100755
  derived and/or modified sequence opt2 from hemagglutinin__InfluenzaA__AFN18117

SEQ ID NO: 100762 - RNA, 1701 nt, Artificial Sequence; identical to SEQ ID NO: 94181
  derived and/or modified sequence opt2 from hemagglutinin__InfluenzaA__AFN18119

SEQ ID NO: 100763 - RNA, 1701 nt, Artificial Sequence
  derived and/or modified sequence opt2 from hemagglutinin__InfluenzaA__AFN18121
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgcccgcuccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccaugguccgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100764 - RNA, 1701 nt, Artificial Sequence; identical to SEQ ID NO: 100755
  derived and/or modified sequence opt2 from hemagglutinin__InfluenzaA__AFN18133

SEQ ID NO: 100765 - RNA, 1701 nt, Artificial Sequence; identical to SEQ ID NO: 100439
  derived and/or modified sequence opt2 from hemagglutinin__InfluenzaA__AFN18135

SEQ ID NO: 100766 - RNA, 1701 nt, Artificial Sequence; identical to SEQ ID NO: 95023
  derived and/or modified sequence opt2 from hemagglutinin__InfluenzaA__AFN18137

SEQ ID NO: 100767 - RNA, 1701 nt, Artificial Sequence
  derived and/or modified sequence opt2 from hemagglutinin__InfluenzaA__AFN18139
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagggccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100768 - RNA, 1701 nt, Artificial Sequence; identical to SEQ ID NO: 100763
  derived and/or modified sequence opt2 from hemagglutinin__InfluenzaA__AFN18141

SEQ ID NO: 100769 - RNA, 1701 nt, Artificial Sequence; identical to SEQ ID NO: 95042
  derived and/or modified sequence opt2 from hemagglutinin__InfluenzaA__AFN18148

SEQ ID NO: 100770 - RNA, 1701 nt, Artificial Sequence; identical to SEQ ID NO: 95345
  derived and/or modified sequence opt2 from hemagglutinin__InfluenzaA__AFN18155

SEQ ID NO: 100771 - RNA, 1701 nt, Artificial Sequence
  derived and/or modified sequence opt2 from hemagglutinin__InfluenzaA__AFN18157
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccggcaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgccuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100772 - RNA, 1701 nt, Artificial Sequence
  derived and/or modified sequence opt2 from hemagglutinin__InfluenzaA__AFN18159
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcuccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100773 - RNA, 1701 nt, Artificial Sequence
  derived and/or modified sequence opt2 from hemagglutinin__InfluenzaA__AFN18164
augaaggccauccucgucguccuccucuacaccuucgccaccaccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucaucgucccccgcuacgccuucgccauggagcgcaacgccggcuccggcaucaucaucuccaacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggagcucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccgucuacuccaccgucgccuccucccucguccucgucgucucccucggcgccaucuccuucuggaugugcuccaacggcucccuccagugccgcaucugcaucuga

SEQ ID NO: 100774 - RNA, 1701 nt, Artificial Sequence
  derived and/or modified sequence opt2 from hemagglutinin__InfluenzaA__AFN18171
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacuccggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaagugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccgucaaggacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100775 - RNA, 1701 nt, Artificial Sequence
  derived and/or modified sequence opt2 from hemagglutinin__InfluenzaA__AFN18176
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100776 - RNA, 1701 nt, Artificial Sequence
  derived and/or modified sequence opt2 from hemagglutinin__InfluenzaA__AFN18183
augaaggccauccucgucguccuccucuacaccuucgccaccgccaacgccgacacccucugcaucggcuaccacgccaacaacuccaccgacaccgucgacaccauccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucauggucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100777 - RNA, 1701 nt, Artificial Sequence; identical to SEQ ID NO: 95733
  derived and/or modified sequence opt2 from hemagglutinin__InfluenzaA__AFN18195

SEQ ID NO: 100778 - RNA, 1701 nt, Artificial Sequence; identical to SEQ ID NO: 94181
  derived and/or modified sequence opt2 from hemagglutinin__InfluenzaA__AFN18200

SEQ ID NO: 100779 - RNA, 1701 nt, Artificial Sequence
  derived and/or modified sequence opt2 from hemagglutinin__InfluenzaA__AFN18207
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagucccucaucuggcucgucaagaagggcaacuccuaccccaagcucuccaaguccuacaucaacgacaagggccgcgagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100780 - RNA, 1701 nt, Artificial Sequence
  derived and/or modified sequence opt2 from hemagglutinin__InfluenzaA__AFN18214
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggaggucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 100781 - RNA, 1701 nt, Artificial Sequence; identical to SEQ ID NO: 96736
  derived and/or modified sequence opt2 from hemagglutinin__InfluenzaA__AFN18224

SEQ ID NO: 100782 - RNA, 1701 nt, Artificial Sequence; identical to SEQ ID NO: 95733
  derived and/or modified sequence opt2 from hemagglutinin__InfluenzaA__AFN18231

SEQ ID NO: 100783 - RNA, 1701 nt, Artificial Sequence
  derived and/or modified sequence opt2 from hemagglutinin__InfluenzaA__AFN18233
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacucccgcaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaagcucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100784 - RNA, 1701 nt, Artificial Sequence
  derived and/or modified sequence opt2 from hemagglutinin__InfluenzaA__AFN18243
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100785 - RNA, 1701 nt, Artificial Sequence; identical to SEQ ID NO: 100270
  derived and/or modified sequence opt2 from hemagglutinin__InfluenzaA__AFN18245

SEQ ID NO: 100786 - RNA, 1701 nt, Artificial Sequence; identical to SEQ ID NO: 96736
  derived and/or modified sequence opt2 from hemagglutinin__InfluenzaA__AFN18255

SEQ ID NO: 100787 - RNA, 1701 nt, Artificial Sequence; identical to SEQ ID NO: 100784
  derived and/or modified sequence opt2 from hemagglutinin__InfluenzaA__AFN18260

SEQ ID NO: 100788 - RNA, 1701 nt, Artificial Sequence; identical to SEQ ID NO: 100784
  derived and/or modified sequence opt2 from hemagglutinin__InfluenzaA__AFN18267

SEQ ID NO: 100789 - RNA, 1701 nt, Artificial Sequence
  derived and/or modified sequence opt2 from hemagglutinin__InfluenzaA__AFN18269
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagaaguucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100790 - RNA, 1701 nt, Artificial Sequence; identical to SEQ ID NO: 95345
  derived and/or modified sequence opt2 from hemagglutinin__InfluenzaA__AFN18271

SEQ ID NO: 100791 - RNA, 1701 nt, Artificial Sequence; identical to SEQ ID NO: 95733
  derived and/or modified sequence opt2 from hemagglutinin__InfluenzaA__AFN18273

SEQ ID NO: 100792 - RNA, 1701 nt, Artificial Sequence; identical to SEQ ID NO: 95345
  derived and/or modified sequence opt2 from hemagglutinin__InfluenzaA__AFN18280

SEQ ID NO: 100793 - RNA, 1701 nt, Artificial Sequence; identical to SEQ ID NO: 94979
  derived and/or modified sequence opt2 from hemagglutinin__InfluenzaA__AFN18303

SEQ ID NO: 100794 - RNA, 1701 nt, Artificial Sequence
  derived and/or modified sequence opt2 from hemagglutinin__InfluenzaA__AFN18305
augaaggccauccucgucguccuccucuacaccuucgccaccgccaacgccgacacccucugcaucggcuaccacgccaacaacuccaccgacaccgucgacaccguccucgagaagaacgucaccgucacccacuccgccaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucggcaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100795 - RNA, 1701 nt, Artificial Sequence
  derived and/or modified sequence opt2 from hemagglutinin__InfluenzaA__AFN18307
augaaggccauccucgucguccuccucuacaccuucgccgccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacaccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100796 - RNA, 1701 nt, Artificial Sequence
  derived and/or modified sequence opt2 from hemagglutinin__InfluenzaA__AFN18312
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcaucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucaucucccucggcgccaucuccuucuggaugugcuccaacggcucccuccagugccgcaucugcaucuga

SEQ ID NO: 100797 - RNA, 1701 nt, Artificial Sequence; identical to SEQ ID NO: 96546
  derived and/or modified sequence opt2 from hemagglutinin__InfluenzaA__AFN18319

SEQ ID NO: 100798 - RNA, 1701 nt, Artificial Sequence; identical to SEQ ID NO: 98643
  derived and/or modified sequence opt2 from hemagglutinin__InfluenzaA__AFN18324

SEQ ID NO: 100799 - RNA, 1701 nt, Artificial Sequence; identical to SEQ ID NO: 94534
  derived and/or modified sequence opt2 from hemagglutinin__InfluenzaA__AFN18334

SEQ ID NO: 100800 - RNA, 1701 nt, Artificial Sequence; identical to SEQ ID NO: 96297
  derived and/or modified sequence opt2 from hemagglutinin__InfluenzaA__AFN18344

SEQ ID NO: 100801 - RNA, 1701 nt, Artificial Sequence; identical to SEQ ID NO: 94181
  derived and/or modified sequence opt2 from hemagglutinin__InfluenzaA__AFN18354

SEQ ID NO: 100802 - RNA, 1701 nt, Artificial Sequence
  derived and/or modified sequence opt2 from hemagglutinin__InfluenzaA__AFN18364
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccucaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaagaucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100803 - RNA, 1701 nt, Artificial Sequence; identical to SEQ ID NO: 94181
  derived and/or modified sequence opt2 from hemagglutinin__InfluenzaA__AFN18374

SEQ ID NO: 100804 - RNA, 1701 nt, Artificial Sequence
  derived and/or modified sequence opt2 from hemagglutinin__InfluenzaA__AFN18381
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccauccgccccaagguccgcgaccaggagggccgcaugaacuacuacuggacccucgucaagcccggcgacaagaucaccuucgaggccaccggcaaccucgucgucccccgcuacgccuucgccauggagcgcaacgccggcuccggcaucaucaucuccgacacccccguccaggacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100805 - RNA, 1701 nt, Artificial Sequence
  derived and/or modified sequence opt2 from hemagglutinin__InfluenzaA__AFN18390
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagauccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100806 - RNA, 1701 nt, Artificial Sequence
  derived and/or modified sequence opt2 from hemagglutinin__InfluenzaA__AFN18400
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucaccccccuccaccucggcaagugcaacaucgccggcuggauccucggcaaccccgagugcgagucccucuccaaggccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgucggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100807 - RNA, 1701 nt, Artificial Sequence; identical to SEQ ID NO: 94272
  derived and/or modified sequence opt2 from hemagglutinin__InfluenzaA__AFN18410

SEQ ID NO: 100808 - RNA, 1701 nt, Artificial Sequence; identical to SEQ ID NO: 94181
  derived and/or modified sequence opt2 from hemagglutinin__InfluenzaA__AFN18420

SEQ ID NO: 100809 - RNA, 1701 nt, Artificial Sequence
  derived and/or modified sequence opt2 from hemagglutinin__InfluenzaA__AFN18430
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgagaacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccaugguccgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100810 - RNA, 1701 nt, Artificial Sequence; identical to SEQ ID NO: 94181
  derived and/or modified sequence opt2 from hemagglutinin__InfluenzaA__AFN18440

SEQ ID NO: 100811 - RNA, 1701 nt, Artificial Sequence; identical to SEQ ID NO: 94181
  derived and/or modified sequence opt2 from hemagglutinin__InfluenzaA__AFN18450

SEQ ID NO: 100812 - RNA, 1701 nt, Artificial Sequence; identical to SEQ ID NO: 96736
  derived and/or modified sequence opt2 from hemagglutinin__InfluenzaA__AFN18460

SEQ ID NO: 100813 - RNA, 1701 nt, Artificial Sequence; identical to SEQ ID NO: 95042
  derived and/or modified sequence opt2 from hemagglutinin__InfluenzaA__AFN18470

SEQ ID NO: 100814 - RNA, 1701 nt, Artificial Sequence; identical to SEQ ID NO: 94272
  derived and/or modified sequence opt2 from hemagglutinin__InfluenzaA__AFN18480

SEQ ID NO: 100815 - RNA, 1701 nt, Artificial Sequence; identical to SEQ ID NO: 95042
  derived and/or modified sequence opt2 from hemagglutinin__InfluenzaA__AFN18490

SEQ ID NO: 100816 - RNA, 1701 nt, Artificial Sequence; identical to SEQ ID NO: 94181
  derived and/or modified sequence opt2 from hemagglutinin__InfluenzaA__AFN18497

SEQ ID NO: 100817 - RNA, 1701 nt, Artificial Sequence; identical to SEQ ID NO: 94181
  derived and/or modified sequence opt2 from hemagglutinin__InfluenzaA__AFN18512

SEQ ID NO: 100818 - RNA, 1701 nt, Artificial Sequence
  derived and/or modified sequence opt2 from hemagglutinin__InfluenzaA__AFN18519
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaaggagaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100819 - RNA, 1701 nt, Artificial Sequence
  derived and/or modified sequence opt2 from hemagglutinin__InfluenzaA__AFN18521
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccaugguccgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccggcgaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100820 - RNA, 1701 nt, Artificial Sequence; identical to SEQ ID NO: 94181
  derived and/or modified sequence opt2 from hemagglutinin__InfluenzaA__AFN18528

SEQ ID NO: 100821 - RNA, 1701 nt, Artificial Sequence; identical to SEQ ID NO: 94181
  derived and/or modified sequence opt2 from hemagglutinin__InfluenzaA__AFN18531

SEQ ID NO: 100822 - RNA, 1701 nt, Artificial Sequence; identical to SEQ ID NO: 96778
  derived and/or modified sequence opt2 from hemagglutinin__InfluenzaA__AFN18543

SEQ ID NO: 100823 - RNA, 1701 nt, Artificial Sequence; identical to SEQ ID NO: 99063
  derived and/or modified sequence opt2 from hemagglutinin__InfluenzaA__AFN18545

SEQ ID NO: 100824 - RNA, 1701 nt, Artificial Sequence; identical to SEQ ID NO: 95042
  derived and/or modified sequence opt2 from hemagglutinin__InfluenzaA__AFN18550

SEQ ID NO: 100825 - RNA, 1701 nt, Artificial Sequence
  derived and/or modified sequence opt2 from hemagglutinin__InfluenzaA__AFN18557
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccgcccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100826 - RNA, 1701 nt, Artificial Sequence
  derived and/or modified sequence opt2 from hemagglutinin__InfluenzaA__AFN18559
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagaaccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100827 - RNA, 1701 nt, Artificial Sequence; identical to SEQ ID NO: 95047
  derived and/or modified sequence opt2 from hemagglutinin__InfluenzaA__AFN18561

SEQ ID NO: 100828 - RNA, 1701 nt, Artificial Sequence; identical to SEQ ID NO: 95283
  derived and/or modified sequence opt2 from hemagglutinin__InfluenzaA__AFN18563

SEQ ID NO: 100829 - RNA, 1701 nt, Artificial Sequence
  derived and/or modified sequence opt2 from hemagglutinin__InfluenzaA__AFN18565
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccaugguccgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcauggagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100830 - RNA, 1701 nt, Artificial Sequence
  derived and/or modified sequence opt2 from hemagglutinin__InfluenzaA__AFN18570
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgucuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100831 - RNA, 1701 nt, Artificial Sequence; identical to SEQ ID NO: 94181
  derived and/or modified sequence opt2 from hemagglutinin__InfluenzaA__AFN18580

SEQ ID NO: 100832 - RNA, 1701 nt, Artificial Sequence; identical to SEQ ID NO: 94423
  derived and/or modified sequence opt2 from hemagglutinin__InfluenzaA__AFN18590

SEQ ID NO: 100833 - RNA, 1701 nt, Artificial Sequence
  derived and/or modified sequence opt2 from hemagglutinin__InfluenzaA__AFN18600
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagaaccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacgccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100834 - RNA, 1701 nt, Artificial Sequence; identical to SEQ ID NO: 94181
  derived and/or modified sequence opt2 from hemagglutinin__InfluenzaA__AFN18610

SEQ ID NO: 100835 - RNA, 1701 nt, Artificial Sequence
  derived and/or modified sequence opt2 from hemagglutinin__InfluenzaA__AFN18617
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccaugguccgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccaguccgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaagcgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100836 - RNA, 1701 nt, Artificial Sequence; identical to SEQ ID NO: 95042
  derived and/or modified sequence opt2 from hemagglutinin__InfluenzaA__AFN18622

SEQ ID NO: 100837 - RNA, 1701 nt, Artificial Sequence; identical to SEQ ID NO: 94181
  derived and/or modified sequence opt2 from hemagglutinin__InfluenzaA__AFN18629

SEQ ID NO: 100838 - RNA, 1701 nt, Artificial Sequence; identical to SEQ ID NO: 94423
  derived and/or modified sequence opt2 from hemagglutinin__InfluenzaA__AFN18634

SEQ ID NO: 100839 - RNA, 1701 nt, Artificial Sequence
  derived and/or modified sequence opt2 from hemagglutinin__InfluenzaA__AFN18644
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccaugguccgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccaguccgccaucgacgagaucaccaacaaggucaacuccgucaucgagaaggucaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100840 - RNA, 1701 nt, Artificial Sequence; identical to SEQ ID NO: 95042
  derived and/or modified sequence opt2 from hemagglutinin__InfluenzaA__AFN18654

SEQ ID NO: 100841 - RNA, 1701 nt, Artificial Sequence; identical to SEQ ID NO: 94181
  derived and/or modified sequence opt2 from hemagglutinin__InfluenzaA__AFN18664

SEQ ID NO: 100842 - RNA, 1701 nt, Artificial Sequence; identical to SEQ ID NO: 94423
  derived and/or modified sequence opt2 from hemagglutinin__InfluenzaA__AFN18674

SEQ ID NO: 100843 - RNA, 1701 nt, Artificial Sequence; identical to SEQ ID NO: 94181
  derived and/or modified sequence opt2 from hemagglutinin__InfluenzaA__AFN18684

SEQ ID NO: 100844 - RNA, 1701 nt, Artificial Sequence; identical to SEQ ID NO: 95042
  derived and/or modified sequence opt2 from hemagglutinin__InfluenzaA__AFN18694

SEQ ID NO: 100845 - RNA, 1701 nt, Artificial Sequence
  derived and/or modified sequence opt2 from hemagglutinin__InfluenzaA__AFN18704
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccaugguccgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccaguccgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100846 - RNA, 1701 nt, Artificial Sequence; identical to SEQ ID NO: 96415
  derived and/or modified sequence opt2 from hemagglutinin__InfluenzaA__AFN18714

SEQ ID NO: 100847 - RNA, 1701 nt, Artificial Sequence; identical to SEQ ID NO: 94181
  derived and/or modified sequence opt2 from hemagglutinin__InfluenzaA__AFN18721

SEQ ID NO: 100848 - RNA, 1701 nt, Artificial Sequence; identical to SEQ ID NO: 96847
  derived and/or modified sequence opt2 from hemagglutinin__InfluenzaA__AFN18725

SEQ ID NO: 100849 - RNA, 1701 nt, Artificial Sequence
  derived and/or modified sequence opt2 from hemagglutinin__InfluenzaA__AFN18735
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagacccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100850 - RNA, 1701 nt, Artificial Sequence; identical to SEQ ID NO: 94181
  derived and/or modified sequence opt2 from hemagglutinin__InfluenzaA__AFN18742

SEQ ID NO: 100851 - RNA, 1701 nt, Artificial Sequence; identical to SEQ ID NO: 95283
  derived and/or modified sequence opt2 from hemagglutinin__InfluenzaA__AFN18747

SEQ ID NO: 100852 - RNA, 1701 nt, Artificial Sequence
  derived and/or modified sequence opt2 from hemagglutinin__InfluenzaA__AFN18757
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgccgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100853 - RNA, 1701 nt, Artificial Sequence; identical to SEQ ID NO: 94181
  derived and/or modified sequence opt2 from hemagglutinin__InfluenzaA__AFN18767

SEQ ID NO: 100854 - RNA, 1701 nt, Artificial Sequence; identical to SEQ ID NO: 100845
  derived and/or modified sequence opt2 from hemagglutinin__InfluenzaA__AFN18774

SEQ ID NO: 100855 - RNA, 1701 nt, Artificial Sequence; identical to SEQ ID NO: 94181
  derived and/or modified sequence opt2 from hemagglutinin__InfluenzaA__AFN18776

SEQ ID NO: 100856 - RNA, 1701 nt, Artificial Sequence; identical to SEQ ID NO: 95047
  derived and/or modified sequence opt2 from hemagglutinin__InfluenzaA__AFN18778

SEQ ID NO: 100857 - RNA, 1701 nt, Artificial Sequence; identical to SEQ ID NO: 94181
  derived and/or modified sequence opt2 from hemagglutinin__InfluenzaA__AFN18784

SEQ ID NO: 100858 - RNA, 1701 nt, Artificial Sequence; identical to SEQ ID NO: 95047
  derived and/or modified sequence opt2 from hemagglutinin__InfluenzaA__AFN18789

SEQ ID NO: 100859 - RNA, 1701 nt, Artificial Sequence; identical to SEQ ID NO: 94181
  derived and/or modified sequence opt2 from hemagglutinin__InfluenzaA__AFN18799

SEQ ID NO: 100860 - RNA, 1701 nt, Artificial Sequence; identical to SEQ ID NO: 94181
  derived and/or modified sequence opt2 from hemagglutinin__InfluenzaA__AFN18809

SEQ ID NO: 100861 - RNA, 1701 nt, Artificial Sequence; identical to SEQ ID NO: 95283
  derived and/or modified sequence opt2 from hemagglutinin__InfluenzaA__AFN18816

SEQ ID NO: 100862 - RNA, 1701 nt, Artificial Sequence; identical to SEQ ID NO: 94181
  derived and/or modified sequence opt2 from hemagglutinin__InfluenzaA__AFN18818

SEQ ID NO: 100863 - RNA, 1701 nt, Artificial Sequence
  derived and/or modified sequence opt2 from hemagglutinin__InfluenzaA__AFN18820
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaacugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100864 - RNA, 1701 nt, Artificial Sequence; identical to SEQ ID NO: 94181
  derived and/or modified sequence opt2 from hemagglutinin__InfluenzaA__AFN18822

SEQ ID NO: 100865 - RNA, 1701 nt, Artificial Sequence
  derived and/or modified sequence opt2 from hemagglutinin__InfluenzaA__AFN18824
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcguccgccucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100866 - RNA, 1701 nt, Artificial Sequence; identical to SEQ ID NO: 100789
  derived and/or modified sequence opt2 from hemagglutinin__InfluenzaA__AFN18826

SEQ ID NO: 100867 - RNA, 1701 nt, Artificial Sequence
  derived and/or modified sequence opt2 from hemagglutinin__InfluenzaA__AFN18828
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaucaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100868 - RNA, 1701 nt, Artificial Sequence; identical to SEQ ID NO: 100852
  derived and/or modified sequence opt2 from hemagglutinin__InfluenzaA__AFN18830

SEQ ID NO: 100869 - RNA, 1701 nt, Artificial Sequence; identical to SEQ ID NO: 94181
  derived and/or modified sequence opt2 from hemagglutinin__InfluenzaA__AFN18832

SEQ ID NO: 100870 - RNA, 1701 nt, Artificial Sequence; identical to SEQ ID NO: 95047
  derived and/or modified sequence opt2 from hemagglutinin__InfluenzaA__AFN18834

SEQ ID NO: 100871 - RNA, 1701 nt, Artificial Sequence
  derived and/or modified sequence opt2 from hemagglutinin__InfluenzaA__AFN18849
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgucgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100872 - RNA, 1701 nt, Artificial Sequence
  derived and/or modified sequence opt2 from hemagglutinin__InfluenzaA__AFN18856
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgagaacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100873 - RNA, 1701 nt, Artificial Sequence; identical to SEQ ID NO: 95042
  derived and/or modified sequence opt2 from hemagglutinin__InfluenzaA__AFN18858

SEQ ID NO: 100874 - RNA, 1701 nt, Artificial Sequence
  derived and/or modified sequence opt2 from hemagglutinin__InfluenzaA__AFN18860
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcucccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcauggacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100875 - RNA, 1701 nt, Artificial Sequence
  derived and/or modified sequence opt2 from hemagglutinin__InfluenzaA__AFN18865
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacaccuccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100876 - RNA, 1701 nt, Artificial Sequence
  derived and/or modified sequence opt2 from hemagglutinin__InfluenzaA__AFN18875
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgcccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100877 - RNA, 1701 nt, Artificial Sequence
  derived and/or modified sequence opt2 from hemagglutinin__InfluenzaA__AFN18885
augaaggccauccucaucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccaaccuccccuuccagaacauccaccccaucaccaucggcaagugccccaaguacgucaaguccaccaagcuccgccucgccaccggccuccgcaacguccccuccacccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugcaagaucugcaucuga

SEQ ID NO: 100878 - RNA, 1701 nt, Artificial Sequence; identical to SEQ ID NO: 94181
  derived and/or modified sequence opt2 from hemagglutinin__InfluenzaA__AFN18892

SEQ ID NO: 100879 - RNA, 1701 nt, Artificial Sequence; identical to SEQ ID NO: 94423
  derived and/or modified sequence opt2 from hemagglutinin__InfluenzaA__AFN18894

SEQ ID NO: 100880 - RNA, 1701 nt, Artificial Sequence; identical to SEQ ID NO: 100845
  derived and/or modified sequence opt2 from hemagglutinin__InfluenzaA__AFN18903

SEQ ID NO: 100881 - RNA, 1701 nt, Artificial Sequence; identical to SEQ ID NO: 95283
  derived and/or modified sequence opt2 from hemagglutinin__InfluenzaA__AFN18910

SEQ ID NO: 100882 - RNA, 1701 nt, Artificial Sequence
  derived and/or modified sequence opt2 from hemagglutinin__InfluenzaA__AFN18912
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacaccuccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100883 - RNA, 1701 nt, Artificial Sequence; identical to SEQ ID NO: 95283
  derived and/or modified sequence opt2 from hemagglutinin__InfluenzaA__AFN18917

SEQ ID NO: 100884 - RNA, 1701 nt, Artificial Sequence; identical to SEQ ID NO: 94181
  derived and/or modified sequence opt2 from hemagglutinin__InfluenzaA__AFN18927

SEQ ID NO: 100885 - RNA, 1701 nt, Artificial Sequence; identical to SEQ ID NO: 96847
  derived and/or modified sequence opt2 from hemagglutinin__InfluenzaA__AFN18937

SEQ ID NO: 100886 - RNA, 1701 nt, Artificial Sequence
  derived and/or modified sequence opt2 from hemagglutinin__InfluenzaA__AFN18952
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaaccgcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100887 - RNA, 1701 nt, Artificial Sequence
  derived and/or modified sequence opt2 from hemagglutinin__InfluenzaA__AFN18957
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaaccacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100888 - RNA, 1701 nt, Artificial Sequence; identical to SEQ ID NO: 100270
  derived and/or modified sequence opt2 from hemagglutinin__InfluenzaA__AFN18964

SEQ ID NO: 100889 - RNA, 1701 nt, Artificial Sequence
  derived and/or modified sequence opt2 from hemagglutinin__InfluenzaA__AFN18974
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccauguccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaagaagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgacgaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100890 - RNA, 1701 nt, Artificial Sequence; identical to SEQ ID NO: 95733
  derived and/or modified sequence opt2 from hemagglutinin__InfluenzaA__AFN18979

SEQ ID NO: 100891 - RNA, 1701 nt, Artificial Sequence
  derived and/or modified sequence opt2 from hemagglutinin__InfluenzaA__AFN18982
augaaggccauccucgucguccuccucuacaccuucgccaucgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccaacuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucaacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100892 - RNA, 1701 nt, Artificial Sequence; identical to SEQ ID NO: 100784
  derived and/or modified sequence opt2 from hemagglutinin__InfluenzaA__AFN18984

SEQ ID NO: 100893 - RNA, 1701 nt, Artificial Sequence; identical to SEQ ID NO: 94181
  derived and/or modified sequence opt2 from hemagglutinin__InfluenzaA__AFN18986

SEQ ID NO: 100894 - RNA, 1701 nt, Artificial Sequence; identical to SEQ ID NO: 94181
  derived and/or modified sequence opt2 from hemagglutinin__InfluenzaA__AFN18988

SEQ ID NO: 100895 - RNA, 1701 nt, Artificial Sequence; identical to SEQ ID NO: 95345
  derived and/or modified sequence opt2 from hemagglutinin__InfluenzaA__AFN18993

SEQ ID NO: 100896 - RNA, 1701 nt, Artificial Sequence; identical to SEQ ID NO: 95345
  derived and/or modified sequence opt2 from hemagglutinin__InfluenzaA__AFN18999

SEQ ID NO: 100897 - RNA, 1701 nt, Artificial Sequence; identical to SEQ ID NO: 94979
  derived and/or modified sequence opt2 from hemagglutinin__InfluenzaA__AFN19006

SEQ ID NO: 100898 - RNA, 1701 nt, Artificial Sequence; identical to SEQ ID NO: 94181
  derived and/or modified sequence opt2 from hemagglutinin__InfluenzaA__AFN19026

SEQ ID NO: 100899 - RNA, 1701 nt, Artificial Sequence; identical to SEQ ID NO: 95321
  derived and/or modified sequence opt2 from hemagglutinin__InfluenzaA__AFN19036

SEQ ID NO: 100900 - RNA, 1701 nt, Artificial Sequence; identical to SEQ ID NO: 94181
  derived and/or modified sequence opt2 from hemagglutinin__InfluenzaA__AFN19043

SEQ ID NO: 100901 - RNA, 1701 nt, Artificial Sequence; identical to SEQ ID NO: 94181
  derived and/or modified sequence opt2 from hemagglutinin__InfluenzaA__AFN19053

SEQ ID NO: 100902 - RNA, 1701 nt, Artificial Sequence; identical to SEQ ID NO: 94181
  derived and/or modified sequence opt2 from hemagglutinin__InfluenzaA__AFN19063

SEQ ID NO: 100903 - RNA, 1701 nt, Artificial Sequence; identical to SEQ ID NO: 94181
  derived and/or modified sequence opt2 from hemagglutinin__InfluenzaA__AFN19070

SEQ ID NO: 100904 - RNA, 1701 nt, Artificial Sequence
  derived and/or modified sequence opt2 from hemagglutinin__InfluenzaA__AFN19076
augaaggccauccucgucguccuccucuacaccuucgccaccgccaacgccgacacccucugcaucggcuaccacgccaacaacuccaccgacaccgucgacaccguccucgagaaggacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100905 - RNA, 1701 nt, Artificial Sequence; identical to SEQ ID NO: 94181
  derived and/or modified sequence opt2 from hemagglutinin__InfluenzaA__AFN19082

SEQ ID NO: 100906 - RNA, 1701 nt, Artificial Sequence; identical to SEQ ID NO: 94181
  derived and/or modified sequence opt2 from hemagglutinin__InfluenzaA__AFN19088

SEQ ID NO: 100907 - RNA, 1701 nt, Artificial Sequence; identical to SEQ ID NO: 94181
  derived and/or modified sequence opt2 from hemagglutinin__InfluenzaA__AFN19097

SEQ ID NO: 100908 - RNA, 1701 nt, Artificial Sequence; identical to SEQ ID NO: 94181
  derived and/or modified sequence opt2 from hemagglutinin__InfluenzaA__AFN19104

SEQ ID NO: 100909 - RNA, 1701 nt, Artificial Sequence; identical to SEQ ID NO: 94181
  derived and/or modified sequence opt2 from hemagglutinin__InfluenzaA__AFN19113

SEQ ID NO: 100910 - RNA, 1701 nt, Artificial Sequence; identical to SEQ ID NO: 94181
  derived and/or modified sequence opt2 from hemagglutinin__InfluenzaA__AFN19119

SEQ ID NO: 100911 - RNA, 1701 nt, Artificial Sequence; identical to SEQ ID NO: 96692
  derived and/or modified sequence opt2 from hemagglutinin__InfluenzaA__AFN19125

SEQ ID NO: 100912 - RNA, 1701 nt, Artificial Sequence; identical to SEQ ID NO: 94181
  derived and/or modified sequence opt2 from hemagglutinin__InfluenzaA__AFN19134

SEQ ID NO: 100913 - RNA, 1701 nt, Artificial Sequence; identical to SEQ ID NO: 94181
  derived and/or modified sequence opt2 from hemagglutinin__InfluenzaA__AFN19144

SEQ ID NO: 100914 - RNA, 1701 nt, Artificial Sequence; identical to SEQ ID NO: 96736
  derived and/or modified sequence opt2 from hemagglutinin__InfluenzaA__AFN19154

SEQ ID NO: 100915 - RNA, 1701 nt, Artificial Sequence; identical to SEQ ID NO: 94181
  derived and/or modified sequence opt2 from hemagglutinin__InfluenzaA__AFN19164

SEQ ID NO: 100916 - RNA, 1701 nt, Artificial Sequence; identical to SEQ ID NO: 94181
  derived and/or modified sequence opt2 from hemagglutinin__InfluenzaA__AFN19174

SEQ ID NO: 100917 - RNA, 1701 nt, Artificial Sequence; identical to SEQ ID NO: 94181
  derived and/or modified sequence opt2 from hemagglutinin__InfluenzaA__AFN19184

SEQ ID NO: 100918 - RNA, 1701 nt, Artificial Sequence; identical to SEQ ID NO: 94181
  derived and/or modified sequence opt2 from hemagglutinin__InfluenzaA__AFN19194

SEQ ID NO: 100919 - RNA, 1701 nt, Artificial Sequence; identical to SEQ ID NO: 94181
  derived and/or modified sequence opt2 from hemagglutinin__InfluenzaA__AFN19203

SEQ ID NO: 100920 - RNA, 1701 nt, Artificial Sequence; identical to SEQ ID NO: 94181
  derived and/or modified sequence opt2 from hemagglutinin__InfluenzaA__AFN19213

SEQ ID NO: 100921 - RNA, 1701 nt, Artificial Sequence; identical to SEQ ID NO: 94181
  derived and/or modified sequence opt2 from hemagglutinin__InfluenzaA__AFN19223

SEQ ID NO: 100922 - RNA, 1701 nt, Artificial Sequence; identical to SEQ ID NO: 94181
  derived and/or modified sequence opt2 from hemagglutinin__InfluenzaA__AFN19233

SEQ ID NO: 100923 - RNA, 1701 nt, Artificial Sequence
  derived and/or modified sequence opt2 from hemagglutinin__InfluenzaA__AFN19243
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccaggacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 100924 - RNA, 1701 nt, Artificial Sequence; identical to SEQ ID NO: 96297
  derived and/or modified sequence opt2 from hemagglutinin__InfluenzaA__AFN19250

SEQ ID NO: 100925 - RNA, 1701 nt, Artificial Sequence; identical to SEQ ID NO: 94181
  derived and/or modified sequence opt2 from hemagglutinin__InfluenzaA__AFN19259

SEQ ID NO: 100926 - RNA, 1701 nt, Artificial Sequence; identical to SEQ ID NO: 94181
  derived and/or modified sequence opt2 from hemagglutinin__InfluenzaA__AFN19269

SEQ ID NO: 100927 - RNA, 1701 nt, Artificial Sequence; identical to SEQ ID NO: 94181
  derived and/or modified sequence opt2 from hemagglutinin__InfluenzaA__AFN19279

SEQ ID NO: 100928 - RNA, 1701 nt, Artificial Sequence; identical to SEQ ID NO: 95042
  derived and/or modified sequence opt2 from hemagglutinin__InfluenzaA__AFN19286

SEQ ID NO: 100929 - RNA, 1701 nt, Artificial Sequence; identical to SEQ ID NO: 94181
  derived and/or modified sequence opt2 from hemagglutinin__InfluenzaA__AFN19295

SEQ ID NO: 100930 - RNA, 1701 nt, Artificial Sequence; identical to SEQ ID NO: 94181
  derived and/or modified sequence opt2 from hemagglutinin__InfluenzaA__AFN19305

SEQ ID NO: 100931 - RNA, 1701 nt, Artificial Sequence; identical to SEQ ID NO: 95047
  derived and/or modified sequence opt2 from hemagglutinin__InfluenzaA__AFN19315

SEQ ID NO: 100932 - RNA, 1701 nt, Artificial Sequence; identical to SEQ ID NO: 94181
  derived and/or modified sequence opt2 from hemagglutinin__InfluenzaA__AFN19325

SEQ ID NO: 100933 - RNA, 1701 nt, Artificial Sequence; identical to SEQ ID NO: 94181
  derived and/or modified sequence opt2 from hemagglutinin__InfluenzaA__AFN19335

SEQ ID NO: 100934 - RNA, 1701 nt, Artificial Sequence; identical to SEQ ID NO: 94181
  derived and/or modified sequence opt2 from hemagglutinin__InfluenzaA__AFN19344

SEQ ID NO: 100935 - RNA, 1701 nt, Artificial Sequence
  derived and/or modified sequence opt2 from hemagglutinin__InfluenzaA__AFN19351
augaagaccaucaucgcccucuccuacauccucugccucgucuucgcccagaagcuccccggcaacgacaacuccauggccacccucugccucggccaccacgccguccccaacggcaccaucgucaagaccaucaccaacgaccagaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacguccgcugcaacaucugcaucuga

SEQ ID NO: 100936 - RNA, 1701 nt, Artificial Sequence; identical to SEQ ID NO: 100586
  derived and/or modified sequence opt2 from hemagglutinin__InfluenzaA__AFN19355

SEQ ID NO: 100937 - RNA, 1701 nt, Artificial Sequence; identical to SEQ ID NO: 100586
  derived and/or modified sequence opt2 from hemagglutinin__InfluenzaA__AFN19357

SEQ ID NO: 100938 - RNA, 1701 nt, Artificial Sequence; identical to SEQ ID NO: 100586
  derived and/or modified sequence opt2 from hemagglutinin__InfluenzaA__AFN19361

SEQ ID NO: 100939 - RNA, 1701 nt, Artificial Sequence
  derived and/or modified sequence opt2 from hemagglutinin__InfluenzaA__AFN19363
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaucuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100940 - RNA, 1701 nt, Artificial Sequence; identical to SEQ ID NO: 98494
  derived and/or modified sequence opt2 from hemagglutinin__InfluenzaA__AFN19365

SEQ ID NO: 100941 - RNA, 1701 nt, Artificial Sequence
  derived and/or modified sequence opt2 from hemagglutinin__InfluenzaA__AFN19367
augaagaccaucaucgcccucuccuacauccucugccucgucuucgcccagaagcuccccgagaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgucaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100942 - RNA, 1701 nt, Artificial Sequence
  derived and/or modified sequence opt2 from hemagglutinin__InfluenzaA__AFN19369
augaagaccaucaucgcccucuccuacauccucugccucgucuucgcccagaagcuccccgagaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgucaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100943 - RNA, 1701 nt, Artificial Sequence
  derived and/or modified sequence opt2 from hemagglutinin__InfluenzaA__AFN19373
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100944 - RNA, 1701 nt, Artificial Sequence; identical to SEQ ID NO: 100586
  derived and/or modified sequence opt2 from hemagglutinin__InfluenzaA__AFN19375

SEQ ID NO: 100945 - RNA, 1701 nt, Artificial Sequence
  derived and/or modified sequence opt2 from hemagglutinin__InfluenzaA__AFN19377
augaagaccaucaucgcccucuccuacauccucugccucgucuucgcccagaagcuccccgagaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgucaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaacggcaacauccgcugcaacaucugcaucuga

SEQ ID NO: 100946 - RNA, 1701 nt, Artificial Sequence; identical to SEQ ID NO: 100586
  derived and/or modified sequence opt2 from hemagglutinin__InfluenzaA__AFN19379

SEQ ID NO: 100947 - RNA, 1701 nt, Artificial Sequence; identical to SEQ ID NO: 100943
  derived and/or modified sequence opt2 from hemagglutinin__InfluenzaA__AFN19381

SEQ ID NO: 100948 - RNA, 1701 nt, Artificial Sequence; identical to SEQ ID NO: 100942
  derived and/or modified sequence opt2 from hemagglutinin__InfluenzaA__AFN19383

SEQ ID NO: 100949 - RNA, 1701 nt, Artificial Sequence
  derived and/or modified sequence opt2 from hemagglutinin__InfluenzaA__AFN19385
augaagaccaucaucgcccucuccuacauccucugccucgucuucgcccagaagcuccccgagaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgucaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgacaucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100950 - RNA, 1701 nt, Artificial Sequence; identical to SEQ ID NO: 100942
  derived and/or modified sequence opt2 from hemagglutinin__InfluenzaA__AFN19387

SEQ ID NO: 100951 - RNA, 1701 nt, Artificial Sequence; identical to SEQ ID NO: 100586
  derived and/or modified sequence opt2 from hemagglutinin__InfluenzaA__AFN19389

SEQ ID NO: 100952 - RNA, 1701 nt, Artificial Sequence; identical to SEQ ID NO: 100586
  derived and/or modified sequence opt2 from hemagglutinin__InfluenzaA__AFN19391

SEQ ID NO: 100953 - RNA, 1701 nt, Artificial Sequence
  derived and/or modified sequence opt2 from hemagglutinin__InfluenzaA__AFN19393
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccgccggcgagaucugcgacuccccccaccacauccucgacggcgagaacugcacccucaucgacgcccuccucggcgacccccagugcgacggcuuccagaacaagaagugggaccucuucgucgagcgcucccgcgccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucuccaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100954 - RNA, 1701 nt, Artificial Sequence; identical to SEQ ID NO: 100942
  derived and/or modified sequence opt2 from hemagglutinin__InfluenzaA__AFN19397

SEQ ID NO: 100955 - RNA, 1701 nt, Artificial Sequence; identical to SEQ ID NO: 100586
  derived and/or modified sequence opt2 from hemagglutinin__InfluenzaA__AFN19399

SEQ ID NO: 100956 - RNA, 1701 nt, Artificial Sequence; identical to SEQ ID NO: 100942
  derived and/or modified sequence opt2 from hemagglutinin__InfluenzaA__AFN19401

SEQ ID NO: 100957 - RNA, 1701 nt, Artificial Sequence; identical to SEQ ID NO: 100586
  derived and/or modified sequence opt2 from hemagglutinin__InfluenzaA__AFN19403

SEQ ID NO: 100958 - RNA, 1701 nt, Artificial Sequence; identical to SEQ ID NO: 100942
  derived and/or modified sequence opt2 from hemagglutinin__InfluenzaA__AFN19405

SEQ ID NO: 100959 - RNA, 1701 nt, Artificial Sequence
  derived and/or modified sequence opt2 from hemagglutinin__InfluenzaA__AFN19407
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugguccggcgucacccagaacggcaccuccuccgccugcaugcgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100960 - RNA, 1701 nt, Artificial Sequence
  derived and/or modified sequence opt2 from hemagglutinin__InfluenzaA__AFN19409
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100961 - RNA, 1701 nt, Artificial Sequence; identical to SEQ ID NO: 100942
  derived and/or modified sequence opt2 from hemagglutinin__InfluenzaA__AFN19411

SEQ ID NO: 100962 - RNA, 1701 nt, Artificial Sequence; identical to SEQ ID NO: 100586
  derived and/or modified sequence opt2 from hemagglutinin__InfluenzaA__AFN19413

SEQ ID NO: 100963 - RNA, 1701 nt, Artificial Sequence
  derived and/or modified sequence opt2 from hemagglutinin__InfluenzaA__AFN19415
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccgucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100964 - RNA, 1701 nt, Artificial Sequence
  derived and/or modified sequence opt2 from hemagglutinin__InfluenzaA__AFN19417
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100965 - RNA, 1701 nt, Artificial Sequence
  derived and/or modified sequence opt2 from hemagglutinin__InfluenzaA__AFN19423
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100966 - RNA, 1701 nt, Artificial Sequence; identical to SEQ ID NO: 100942
  derived and/or modified sequence opt2 from hemagglutinin__InfluenzaA__AFN19425

SEQ ID NO: 100967 - RNA, 1701 nt, Artificial Sequence
  derived and/or modified sequence opt2 from hemagglutinin__InfluenzaA__AFN19437
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuuccgcauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaaccgcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacuacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100968 - RNA, 1701 nt, Artificial Sequence
  derived and/or modified sequence opt2 from hemagglutinin__InfluenzaA__AFN19439
augaagaccaucaucgcccucucccacauccucugccucgucuucgcccagaagcuccccgagaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaucaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccagcccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100969 - RNA, 1701 nt, Artificial Sequence; identical to SEQ ID NO: 100943
  derived and/or modified sequence opt2 from hemagglutinin__InfluenzaA__AFN19443

SEQ ID NO: 100970 - RNA, 1701 nt, Artificial Sequence
  derived and/or modified sequence opt2 from hemagglutinin__InfluenzaA__AFN19445
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccuccgccucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100971 - RNA, 1701 nt, Artificial Sequence; identical to SEQ ID NO: 100965
  derived and/or modified sequence opt2 from hemagglutinin__InfluenzaA__AFN19447

SEQ ID NO: 100972 - RNA, 1701 nt, Artificial Sequence
  derived and/or modified sequence opt2 from hemagglutinin__InfluenzaA__AFN19451
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaacggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100973 - RNA, 1701 nt, Artificial Sequence
  derived and/or modified sequence opt2 from hemagglutinin__InfluenzaA__AFN19453
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccaggucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100974 - RNA, 1701 nt, Artificial Sequence; identical to SEQ ID NO: 100965
  derived and/or modified sequence opt2 from hemagglutinin__InfluenzaA__AFN19455

SEQ ID NO: 100975 - RNA, 1701 nt, Artificial Sequence; identical to SEQ ID NO: 100586
  derived and/or modified sequence opt2 from hemagglutinin__InfluenzaA__AFN19457

SEQ ID NO: 100976 - RNA, 1701 nt, Artificial Sequence; identical to SEQ ID NO: 100586
  derived and/or modified sequence opt2 from hemagglutinin__InfluenzaA__AFN19459

SEQ ID NO: 100977 - RNA, 1701 nt, Artificial Sequence; identical to SEQ ID NO: 100943
  derived and/or modified sequence opt2 from hemagglutinin__InfluenzaA__AFN19461

SEQ ID NO: 100978 - RNA, 1701 nt, Artificial Sequence
  derived and/or modified sequence opt2 from hemagglutinin__InfluenzaA__AFN19465
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaucggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcaucgcccuccucggcuucaucaugugggccugccagaagggcaacauccgcugcaacaucugcaucuga

SEQ ID NO: 100979 - RNA, 1701 nt, Artificial Sequence; identical to SEQ ID NO: 100965
  derived and/or modified sequence opt2 from hemagglutinin__InfluenzaA__AFN19467

SEQ ID NO: 100980 - RNA, 1701 nt, Artificial Sequence; identical to SEQ ID NO: 100973
  derived and/or modified sequence opt2 from hemagglutinin__InfluenzaA__AFN19469

SEQ ID NO: 100981 - RNA, 1701 nt, Artificial Sequence; identical to SEQ ID NO: 100586
  derived and/or modified sequence opt2 from hemagglutinin__InfluenzaA__AFN19471

SEQ ID NO: 100982 - RNA, 1701 nt, Artificial Sequence
  derived and/or modified sequence opt2 from hemagglutinin__InfluenzaA__AFN19473
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcggcuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100983 - RNA, 1701 nt, Artificial Sequence; identical to SEQ ID NO: 100965
  derived and/or modified sequence opt2 from hemagglutinin__InfluenzaA__AFN19475

SEQ ID NO: 100984 - RNA, 1701 nt, Artificial Sequence; identical to SEQ ID NO: 100586
  derived and/or modified sequence opt2 from hemagglutinin__InfluenzaA__AFN19477

SEQ ID NO: 100985 - RNA, 1701 nt, Artificial Sequence
  derived and/or modified sequence opt2 from hemagglutinin__InfluenzaA__AFN19479
augaagaccaucaucgcccucuccugcauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100986 - RNA, 1701 nt, Artificial Sequence; identical to SEQ ID NO: 100965
  derived and/or modified sequence opt2 from hemagglutinin__InfluenzaA__AFN19483

SEQ ID NO: 100987 - RNA, 1701 nt, Artificial Sequence; identical to SEQ ID NO: 98367
  derived and/or modified sequence opt2 from hemagglutinin__InfluenzaA__AFN19485

SEQ ID NO: 100988 - RNA, 1701 nt, Artificial Sequence; identical to SEQ ID NO: 100586
  derived and/or modified sequence opt2 from hemagglutinin__InfluenzaA__AFN19487

SEQ ID NO: 100989 - RNA, 1701 nt, Artificial Sequence
  derived and/or modified sequence opt2 from hemagglutinin__InfluenzaA__AFN19491
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 100990 - RNA, 1701 nt, Artificial Sequence
  derived and/or modified sequence opt2 from hemagglutinin__InfluenzaA__AFN19493
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100991 - RNA, 1701 nt, Artificial Sequence
  derived and/or modified sequence opt2 from hemagglutinin__InfluenzaA__AFN19495
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccagaucgaggucaccaacgccaccgagcucguccaguccuccuccgccggcgagaucugcgacuccccccaccacauccucgacggcgagaacugcacccucaucgacgcccuccucggcgacccccagugcgacggcuuccagaacaagaagugggaccucuucgucgagcgcucccgcgccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaccuccugcuuccuccucugcgucgcccuccucggcuucaucaugugggccugccagaagggcaacauccgcugcaacaucugcaucuga

SEQ ID NO: 100992 - RNA, 1701 nt, Artificial Sequence
  derived and/or modified sequence opt2 from hemagglutinin__InfluenzaA__AFN19497
augaagaccaucaucgcccucuccuacauccucugccucgucuucgcccagaagcuccccgagaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccaccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 100993 - RNA, 1701 nt, Artificial Sequence; identical to SEQ ID NO: 100943
  derived and/or modified sequence opt2 from hemagglutinin__InfluenzaA__AFN19499

SEQ ID NO: 100994 - RNA, 1701 nt, Artificial Sequence; identical to SEQ ID NO: 100942
  derived and/or modified sequence opt2 from hemagglutinin__InfluenzaA__AFN19501

SEQ ID NO: 100995 - RNA, 1701 nt, Artificial Sequence; identical to SEQ ID NO: 98494
  derived and/or modified sequence opt2 from hemagglutinin__InfluenzaA__AFN19503

SEQ ID NO: 100996 - RNA, 1701 nt, Artificial Sequence; identical to SEQ ID NO: 100943
  derived and/or modified sequence opt2 from hemagglutinin__InfluenzaA__AFN19507

SEQ ID NO: 100997 - RNA, 1701 nt, Artificial Sequence; identical to SEQ ID NO: 100942
  derived and/or modified sequence opt2 from hemagglutinin__InfluenzaA__AFN19509

SEQ ID NO: 100998 - RNA, 1701 nt, Artificial Sequence; identical to SEQ ID NO: 100943
  derived and/or modified sequence opt2 from hemagglutinin__InfluenzaA__AFN19513

SEQ ID NO: 100999 - RNA, 1701 nt, Artificial Sequence; identical to SEQ ID NO: 100942
  derived and/or modified sequence opt2 from hemagglutinin__InfluenzaA__AFN19515

SEQ ID NO: 101000 - RNA, 1701 nt, Artificial Sequence; identical to SEQ ID NO: 100943
  derived and/or modified sequence opt2 from hemagglutinin__InfluenzaA__AFN19517

SEQ ID NO: 101001 - RNA, 1701 nt, Artificial Sequence; identical to SEQ ID NO: 100943
  derived and/or modified sequence opt2 from hemagglutinin__InfluenzaA__AFN19519

SEQ ID NO: 101002 - RNA, 1701 nt, Artificial Sequence; identical to SEQ ID NO: 100586
  derived and/or modified sequence opt2 from hemagglutinin__InfluenzaA__AFN19521

SEQ ID NO: 101003 - RNA, 1701 nt, Artificial Sequence; identical to SEQ ID NO: 100942
  derived and/or modified sequence opt2 from hemagglutinin__InfluenzaA__AFN19523

SEQ ID NO: 101004 - RNA, 1701 nt, Artificial Sequence
  derived and/or modified sequence opt2 from hemagglutinin__InfluenzaA__AFN19527
augaagaccaucaucgcccucuccuacacccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101005 - RNA, 1701 nt, Artificial Sequence
  derived and/or modified sequence opt2 from hemagglutinin__InfluenzaA__AFN19529
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101006 - RNA, 1701 nt, Artificial Sequence; identical to SEQ ID NO: 100586
  derived and/or modified sequence opt2 from hemagglutinin__InfluenzaA__AFN19531

SEQ ID NO: 101007 - RNA, 1701 nt, Artificial Sequence; identical to SEQ ID NO: 101005
  derived and/or modified sequence opt2 from hemagglutinin__InfluenzaA__AFN19533

SEQ ID NO: 101008 - RNA, 1701 nt, Artificial Sequence
  derived and/or modified sequence opt2 from hemagglutinin__InfluenzaA__AFN19535
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101009 - RNA, 1701 nt, Artificial Sequence; identical to SEQ ID NO: 100586
  derived and/or modified sequence opt2 from hemagglutinin__InfluenzaA__AFN19537

SEQ ID NO: 101010 - RNA, 1701 nt, Artificial Sequence; identical to SEQ ID NO: 100586
  derived and/or modified sequence opt2 from hemagglutinin__InfluenzaA__AFN19539

SEQ ID NO: 101011 - RNA, 1701 nt, Artificial Sequence; identical to SEQ ID NO: 100586
  derived and/or modified sequence opt2 from hemagglutinin__InfluenzaA__AFN19543

SEQ ID NO: 101012 - RNA, 1701 nt, Artificial Sequence
  derived and/or modified sequence opt2 from hemagglutinin__InfluenzaA__AFN19545
augaagaccaucaucgcccucuccuacauccucugccucgucuucgcccagaagcuccccggcuccgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuucaagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101013 - RNA, 1701 nt, Artificial Sequence; identical to SEQ ID NO: 100586
  derived and/or modified sequence opt2 from hemagglutinin__InfluenzaA__AFN19547

SEQ ID NO: 101014 - RNA, 1701 nt, Artificial Sequence
  derived and/or modified sequence opt2 from hemagglutinin__InfluenzaA__AFN19549
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaagggcgagaucugcaacuccccccaccagauccucgacggcggcaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcaugcgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggacaucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101015 - RNA, 1701 nt, Artificial Sequence
  derived and/or modified sequence opt2 from hemagglutinin__InfluenzaA__AFN19551
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccacugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101016 - RNA, 1701 nt, Artificial Sequence; identical to SEQ ID NO: 100965
  derived and/or modified sequence opt2 from hemagglutinin__InfluenzaA__AFN19553

SEQ ID NO: 101017 - RNA, 1701 nt, Artificial Sequence; identical to SEQ ID NO: 100965
  derived and/or modified sequence opt2 from hemagglutinin__InfluenzaA__AFN19555

SEQ ID NO: 101018 - RNA, 1701 nt, Artificial Sequence; identical to SEQ ID NO: 100586
  derived and/or modified sequence opt2 from hemagglutinin__InfluenzaA__AFN19557

SEQ ID NO: 101019 - RNA, 1701 nt, Artificial Sequence; identical to SEQ ID NO: 100965
  derived and/or modified sequence opt2 from hemagglutinin__InfluenzaA__AFN19559

SEQ ID NO: 101020 - RNA, 1701 nt, Artificial Sequence; identical to SEQ ID NO: 100973
  derived and/or modified sequence opt2 from hemagglutinin__InfluenzaA__AFN19561

SEQ ID NO: 101021 - RNA, 1701 nt, Artificial Sequence
  derived and/or modified sequence opt2 from hemagglutinin__InfluenzaA__AFN19563
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaccuccugcuuccuccucugcgucgcccuccucggcuucaucaugugggccugccagaagggcaacauccgcugcaacaucugcaucuga

SEQ ID NO: 101022 - RNA, 1701 nt, Artificial Sequence; identical to SEQ ID NO: 100943
  derived and/or modified sequence opt2 from hemagglutinin__InfluenzaA__AFN19565

SEQ ID NO: 101023 - RNA, 1701 nt, Artificial Sequence
  derived and/or modified sequence opt2 from hemagglutinin__InfluenzaA__AFN19567
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101024 - RNA, 1701 nt, Artificial Sequence; identical to SEQ ID NO: 100586
  derived and/or modified sequence opt2 from hemagglutinin__InfluenzaA__AFN19569

SEQ ID NO: 101025 - RNA, 1701 nt, Artificial Sequence
  derived and/or modified sequence opt2 from hemagglutinin__InfluenzaA__AFN19571
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacucccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuuccgcauccgcuccggcaaguccuccaucaugcgcuccgacgcccccaucggcaagugcaacuccgagugcaucacccccaacggcuccauccccaacgacaagcccuuccagaacgucaaccgcaucaccuacggccccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuaccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucuggaccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101026 - RNA, 1701 nt, Artificial Sequence
  derived and/or modified sequence opt2 from hemagglutinin__InfluenzaA__AFN19573
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcaagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaagaacuccuucuucucccgccucaacuggcucacccaccucaacuucaaguacuccgcccucaacgucaccaugcccaacaaggagcaguucgacaagcucuacaucuggggcguccaccaccccggcaccgacaaggaccagaucucccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagaugcaguccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101027 - RNA, 1701 nt, Artificial Sequence
  derived and/or modified sequence opt2 from hemagglutinin__InfluenzaA__AFN19575
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacaacccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101028 - RNA, 1701 nt, Artificial Sequence; identical to SEQ ID NO: 100942
  derived and/or modified sequence opt2 from hemagglutinin__InfluenzaA__AFN19577

SEQ ID NO: 101029 - RNA, 1701 nt, Artificial Sequence; identical to SEQ ID NO: 100942
  derived and/or modified sequence opt2 from hemagglutinin__InfluenzaA__AFN19579

SEQ ID NO: 101030 - RNA, 1701 nt, Artificial Sequence; identical to SEQ ID NO: 100942
  derived and/or modified sequence opt2 from hemagglutinin__InfluenzaA__AFN19581

SEQ ID NO: 101031 - RNA, 1701 nt, Artificial Sequence; identical to SEQ ID NO: 100942
  derived and/or modified sequence opt2 from hemagglutinin__InfluenzaA__AFN19583

SEQ ID NO: 101032 - RNA, 1701 nt, Artificial Sequence
  derived and/or modified sequence opt2 from hemagglutinin__InfluenzaA__AFN19587
augaagaccaucaucgcccucuccuacauccucugccucgucuucgcccagaagcuccccgagaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgucaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacgagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101033 - RNA, 1701 nt, Artificial Sequence; identical to SEQ ID NO: 100942
  derived and/or modified sequence opt2 from hemagglutinin__InfluenzaA__AFN19589

SEQ ID NO: 101034 - RNA, 1701 nt, Artificial Sequence
  derived and/or modified sequence opt2 from hemagglutinin__InfluenzaA__AFN19591
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaugcgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaacggcaacauccgcugcaacaucugcaucuga

SEQ ID NO: 101035 - RNA, 1701 nt, Artificial Sequence; identical to SEQ ID NO: 100942
  derived and/or modified sequence opt2 from hemagglutinin__InfluenzaA__AFN19593

SEQ ID NO: 101036 - RNA, 1701 nt, Artificial Sequence; identical to SEQ ID NO: 100943
  derived and/or modified sequence opt2 from hemagglutinin__InfluenzaA__AFN19595

SEQ ID NO: 101037 - RNA, 1701 nt, Artificial Sequence; identical to SEQ ID NO: 100943
  derived and/or modified sequence opt2 from hemagglutinin__InfluenzaA__AFN19599

SEQ ID NO: 101038 - RNA, 1701 nt, Artificial Sequence; identical to SEQ ID NO: 101005
  derived and/or modified sequence opt2 from hemagglutinin__InfluenzaA__AFN19601

SEQ ID NO: 101039 - RNA, 1701 nt, Artificial Sequence; identical to SEQ ID NO: 100586
  derived and/or modified sequence opt2 from hemagglutinin__InfluenzaA__AFN19607

SEQ ID NO: 101040 - RNA, 1701 nt, Artificial Sequence; identical to SEQ ID NO: 100942
  derived and/or modified sequence opt2 from hemagglutinin__InfluenzaA__AFN19609

SEQ ID NO: 101041 - RNA, 1701 nt, Artificial Sequence
  derived and/or modified sequence opt2 from hemagglutinin__InfluenzaA__AFN19611
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucgagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101042 - RNA, 1701 nt, Artificial Sequence; identical to SEQ ID NO: 100965
  derived and/or modified sequence opt2 from hemagglutinin__InfluenzaA__AFN19613

SEQ ID NO: 101043 - RNA, 1701 nt, Artificial Sequence; identical to SEQ ID NO: 100943
  derived and/or modified sequence opt2 from hemagglutinin__InfluenzaA__AFN19617

SEQ ID NO: 101044 - RNA, 1701 nt, Artificial Sequence
  derived and/or modified sequence opt2 from hemagglutinin__InfluenzaA__AFN19619
augaagaccaucaucgcccucucccacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcuccaagccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 101045 - RNA, 1701 nt, Artificial Sequence; identical to SEQ ID NO: 101005
  derived and/or modified sequence opt2 from hemagglutinin__InfluenzaA__AFN19623

SEQ ID NO: 101046 - RNA, 1701 nt, Artificial Sequence; identical to SEQ ID NO: 100942
  derived and/or modified sequence opt2 from hemagglutinin__InfluenzaA__AFN19629

SEQ ID NO: 101047 - RNA, 1701 nt, Artificial Sequence
  derived and/or modified sequence opt2 from hemagglutinin__InfluenzaA__AFN19631
augaagaccaucaucgcccucuccuacauccucugccucgucuucgcccagaagcuccccgagaacgacuacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaucaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaccuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccagcccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101048 - RNA, 1701 nt, Artificial Sequence
  derived and/or modified sequence opt2 from hemagglutinin__InfluenzaA__AFN19633
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccaucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101049 - RNA, 1701 nt, Artificial Sequence
  derived and/or modified sequence opt2 from hemagglutinin__InfluenzaA__AFN19635
augaagaccaucaucgcccucuccuacauccucugccucgucuucgcccagaagcuccccgagaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaucaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccagcccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101050 - RNA, 1701 nt, Artificial Sequence; identical to SEQ ID NO: 101049
  derived and/or modified sequence opt2 from hemagglutinin__InfluenzaA__AFN19637

SEQ ID NO: 101051 - RNA, 1701 nt, Artificial Sequence; identical to SEQ ID NO: 100586
  derived and/or modified sequence opt2 from hemagglutinin__InfluenzaA__AFN19639

SEQ ID NO: 101052 - RNA, 1701 nt, Artificial Sequence; identical to SEQ ID NO: 101005
  derived and/or modified sequence opt2 from hemagglutinin__InfluenzaA__AFN19641

SEQ ID NO: 101053 - RNA, 1701 nt, Artificial Sequence; identical to SEQ ID NO: 101049
  derived and/or modified sequence opt2 from hemagglutinin__InfluenzaA__AFN19643

SEQ ID NO: 101054 - RNA, 1701 nt, Artificial Sequence; identical to SEQ ID NO: 100586
  derived and/or modified sequence opt2 from hemagglutinin__InfluenzaA__AFN19645

SEQ ID NO: 101055 - RNA, 1701 nt, Artificial Sequence
  derived and/or modified sequence opt2 from hemagglutinin__InfluenzaA__AFN19647
augaagaccaucaucgcccucuccuacauccucugccucgucuucgcccagaagcuccccgagaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgucaacugcacccucaucgacgcccuccucggcgacccccagugcgacggcuuccagaacaagaagugggaccucuucgucgagcgcuccaaggccuacuccaacugcuaccccuacgacguccccgacuacgccucccucaagucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101056 - RNA, 1701 nt, Artificial Sequence
  derived and/or modified sequence opt2 from hemagglutinin__InfluenzaA__AFN19649
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaucuccgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101057 - RNA, 1701 nt, Artificial Sequence; identical to SEQ ID NO: 101049
  derived and/or modified sequence opt2 from hemagglutinin__InfluenzaA__AFN19653

SEQ ID NO: 101058 - RNA, 1701 nt, Artificial Sequence; identical to SEQ ID NO: 100965
  derived and/or modified sequence opt2 from hemagglutinin__InfluenzaA__AFN19663

SEQ ID NO: 101059 - RNA, 1701 nt, Artificial Sequence; identical to SEQ ID NO: 100973
  derived and/or modified sequence opt2 from hemagglutinin__InfluenzaA__AFN19665

SEQ ID NO: 101060 - RNA, 1701 nt, Artificial Sequence
  derived and/or modified sequence opt2 from hemagglutinin__InfluenzaA__AFN19667
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaugcgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101061 - RNA, 1701 nt, Artificial Sequence
  derived and/or modified sequence opt2 from hemagglutinin__InfluenzaA__AFN19669
augaagaccaucaucgcccucuccuacauccucugcauggucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccaacuacgccucccuccgcucccucgucgccuccuccggcacccucgaguucaacaacgaguccuucaacuggaccggcgucacccagaacggcaccuccuccgccugcaugcgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101062 - RNA, 1701 nt, Artificial Sequence
  derived and/or modified sequence opt2 from hemagglutinin__InfluenzaA__AFN19671
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101063 - RNA, 1701 nt, Artificial Sequence; identical to SEQ ID NO: 100586
  derived and/or modified sequence opt2 from hemagglutinin__InfluenzaA__AFN19674

SEQ ID NO: 101064 - RNA, 1701 nt, Artificial Sequence; identical to SEQ ID NO: 100586
  derived and/or modified sequence opt2 from hemagglutinin__InfluenzaA__AFN19676

SEQ ID NO: 101065 - RNA, 1701 nt, Artificial Sequence; identical to SEQ ID NO: 100973
  derived and/or modified sequence opt2 from hemagglutinin__InfluenzaA__AFN19678

SEQ ID NO: 101066 - RNA, 1701 nt, Artificial Sequence
  derived and/or modified sequence opt2 from hemagglutinin__InfluenzaA__AFN19682
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccaacuacgccucccuccgcucccucgucgccuccuccggcacccucgaguucaacaacgaguccuucaacuggaccggcgucacccagaacggcaccuccuccgccugcaugcgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacaucaagugcaacaucugcaucuga

SEQ ID NO: 101067 - RNA, 1701 nt, Artificial Sequence
  derived and/or modified sequence opt2 from hemagglutinin__InfluenzaA__AFN19684
augaagaccaucaucgcccucuccuacauccucugccucgccuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101068 - RNA, 1701 nt, Artificial Sequence
  derived and/or modified sequence opt2 from hemagglutinin__InfluenzaA__AFN19686
augaagaccaucaucgcccucuccuacauccucugccucgccuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacauccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101069 - RNA, 1701 nt, Artificial Sequence
  derived and/or modified sequence opt2 from hemagglutinin__InfluenzaA__AFN19688
augaagaccaucaucgcccucuccuacauccucugccucgucuucgcccaggagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101070 - RNA, 1701 nt, Artificial Sequence
  derived and/or modified sequence opt2 from hemagglutinin__InfluenzaA__AFN19690
augaagaccaccaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgaccucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101071 - RNA, 1701 nt, Artificial Sequence
  derived and/or modified sequence opt2 from hemagglutinin__InfluenzaA__AFN19692
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccgacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101072 - RNA, 1701 nt, Artificial Sequence
  derived and/or modified sequence opt2 from hemagglutinin__InfluenzaA__AFN19694
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacucccccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101073 - RNA, 1701 nt, Artificial Sequence
  derived and/or modified sequence opt2 from hemagglutinin__InfluenzaA__AFN19700
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgagcgcuucaacugguccggcgucacccagaacggcaccuccuccgccugcaugcgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101074 - RNA, 1701 nt, Artificial Sequence
  derived and/or modified sequence opt2 from hemagglutinin__InfluenzaA__AFN19702
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcggcaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101075 - RNA, 1701 nt, Artificial Sequence; identical to SEQ ID NO: 98327
  derived and/or modified sequence opt2 from hemagglutinin__InfluenzaA__AFN19709

SEQ ID NO: 101076 - RNA, 1701 nt, Artificial Sequence
  derived and/or modified sequence opt2 from hemagglutinin__InfluenzaA__AFN19719
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcacccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcgucuaccagauccucgccaucuacuccaccgucgccuccucccucguccucgucgucucccucggcgccaucuccuucuggaugugcuccaacggcucccuccagugccgcaucugcaucuga

SEQ ID NO: 101077 - RNA, 1701 nt, Artificial Sequence; identical to SEQ ID NO: 97947
  derived and/or modified sequence opt2 from hemagglutinin__InfluenzaA__AFN19730

SEQ ID NO: 101078 - RNA, 1701 nt, Artificial Sequence; identical to SEQ ID NO: 98327
  derived and/or modified sequence opt2 from hemagglutinin__InfluenzaA__AFN19736

SEQ ID NO: 101079 - RNA, 1701 nt, Artificial Sequence
  derived and/or modified sequence opt2 from hemagglutinin__InfluenzaA__AFN19748
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaccggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaccggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101080 - RNA, 1701 nt, Artificial Sequence; identical to SEQ ID NO: 98336
  derived and/or modified sequence opt2 from hemagglutinin__InfluenzaA__AFN19757

SEQ ID NO: 101081 - RNA, 1701 nt, Artificial Sequence; identical to SEQ ID NO: 98327
  derived and/or modified sequence opt2 from hemagglutinin__InfluenzaA__AFN19768

SEQ ID NO: 101082 - RNA, 1701 nt, Artificial Sequence
  derived and/or modified sequence opt2 from hemagglutinin__InfluenzaA__AFN19781
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccgucgagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101083 - RNA, 1701 nt, Artificial Sequence
  derived and/or modified sequence opt2 from hemagglutinin__InfluenzaA__AFN19791
augaaggccauccucgucguccuccucuacaccuucgccaucgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccguccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucaucgucucccucggcgccaucuccuucuggaugugcuccaacggcucccuccagugccgcaucugcaucuga

SEQ ID NO: 101084 - RNA, 1701 nt, Artificial Sequence; identical to SEQ ID NO: 98327
  derived and/or modified sequence opt2 from hemagglutinin__InfluenzaA__AFN19806

SEQ ID NO: 101085 - RNA, 1701 nt, Artificial Sequence
  derived and/or modified sequence opt2 from hemagglutinin__InfluenzaA__AFN19808
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccaacuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccaacuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccgcccacgacugcaacaccaccugccagacccccaagggcgccaucaacaccucccuccccuuccagaacauccaccccaucaccaucggcaagugccccaaguacgucaacuccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101086 - RNA, 1701 nt, Artificial Sequence; identical to SEQ ID NO: 98336
  derived and/or modified sequence opt2 from hemagglutinin__InfluenzaA__AFN19814

SEQ ID NO: 101087 - RNA, 1701 nt, Artificial Sequence
  derived and/or modified sequence opt2 from hemagglutinin__InfluenzaA__AFN19816
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcgacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101088 - RNA, 1701 nt, Artificial Sequence
  derived and/or modified sequence opt2 from hemagglutinin__InfluenzaA__AFN19821
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaagcucaagcccgagaucgccauccgccccaagguccgcgaccaggagggccgcaugaacuacuacuggacccucgucgagcccggcggcaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101089 - RNA, 1701 nt, Artificial Sequence; identical to SEQ ID NO: 97947
  derived and/or modified sequence opt2 from hemagglutinin__InfluenzaA__AFN19831

SEQ ID NO: 101090 - RNA, 1701 nt, Artificial Sequence
  derived and/or modified sequence opt2 from hemagglutinin__InfluenzaA__AFN19849
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcgacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccaggccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccguccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgcccagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcgacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101091 - RNA, 1701 nt, Artificial Sequence
  derived and/or modified sequence opt2 from hemagglutinin__InfluenzaA__AFN19865
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccucguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101092 - RNA, 1701 nt, Artificial Sequence
  derived and/or modified sequence opt2 from hemagglutinin__InfluenzaA__AFN19875
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgagaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccguccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101093 - RNA, 1701 nt, Artificial Sequence
  derived and/or modified sequence opt2 from hemagglutinin__InfluenzaA__AFN19895
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagaucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggccgcugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaccggcaacggcugcuucgaguucuaccacaagugcgacaacaccugcauggaguccgucaagaacggcaccuacgacuaccccaaguacuccgaggaggccaagcucaaccgcgaggucaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101094 - RNA, 1701 nt, Artificial Sequence
  derived and/or modified sequence opt2 from hemagglutinin__InfluenzaA__AFN19905
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccgucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucaucgucucccucggcgccaucuccuucuggaugugcuccaacggcucccuccagugccgcaucugcaucuga

SEQ ID NO: 101095 - RNA, 1701 nt, Artificial Sequence
  derived and/or modified sequence opt2 from hemagglutinin__InfluenzaA__AFN19915
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccaggccggcgccaaguccuucuacaagaaccucaucuggcucgucaagaagggcaacuccuaccccaagcucuccuccuccuacaucaacgacaagggcaaggagguccucguccucuggggcauccaccaccccuccaccuccgccgaccagcagucccucuaccagaacgccgacgccuacgucuucgucggcaccuccgaguacuccaagaaguucaagcccgagaucgccguccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgcccagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101096 - RNA, 1701 nt, Artificial Sequence
  derived and/or modified sequence opt2 from hemagglutinin__InfluenzaA__AFN19922
augaaggccauccucgucgucguccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucucccgcuccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccgcccaggacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101097 - RNA, 1701 nt, Artificial Sequence; identical to SEQ ID NO: 97966
  derived and/or modified sequence opt2 from hemagglutinin__InfluenzaA__AFN19931

SEQ ID NO: 101098 - RNA, 1701 nt, Artificial Sequence
  derived and/or modified sequence opt2 from hemagglutinin__InfluenzaA__AFN19941
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaucuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccaggccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccguccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgcccagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101099 - RNA, 1701 nt, Artificial Sequence
  derived and/or modified sequence opt2 from hemagglutinin__InfluenzaA__AFN19951
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaccggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 101100 - RNA, 1701 nt, Artificial Sequence; identical to SEQ ID NO: 98327
  derived and/or modified sequence opt2 from hemagglutinin__InfluenzaA__AFN19966

SEQ ID NO: 101101 - RNA, 1701 nt, Artificial Sequence
  derived and/or modified sequence opt2 from hemagglutinin__InfluenzaA__AFN19972
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacaacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcgucuaccagauccucgccaucuacuccaccgucgccuccucccucguccucgucgucucccucggcgccaucuccuucuggaugugcuccaacggcucccuccagugccgcaucugcaucuga

SEQ ID NO: 101102 - RNA, 1701 nt, Artificial Sequence
  derived and/or modified sequence opt2 from hemagglutinin__InfluenzaA__AFN19978
augaaggccauccucgucgucaugcucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101103 - RNA, 1701 nt, Artificial Sequence; identical to SEQ ID NO: 98327
  derived and/or modified sequence opt2 from hemagglutinin__InfluenzaA__AFN19983

SEQ ID NO: 101104 - RNA, 1701 nt, Artificial Sequence
  derived and/or modified sequence opt2 from hemagglutinin__InfluenzaA__AFN19993
augaaggccauccucgucguccuccucuacaccgucgccaccaccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101105 - RNA, 1701 nt, Artificial Sequence; identical to SEQ ID NO: 98327
  derived and/or modified sequence opt2 from hemagglutinin__InfluenzaA__AFN20000

SEQ ID NO: 101106 - RNA, 1701 nt, Artificial Sequence; identical to SEQ ID NO: 98334
  derived and/or modified sequence opt2 from hemagglutinin__InfluenzaA__AFN20006

SEQ ID NO: 101107 - RNA, 1701 nt, Artificial Sequence; identical to SEQ ID NO: 97966
  derived and/or modified sequence opt2 from hemagglutinin__InfluenzaA__AFN20012

SEQ ID NO: 101108 - RNA, 1701 nt, Artificial Sequence
  derived and/or modified sequence opt2 from hemagglutinin__InfluenzaA__AFN20018
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccaggccggcgccaaguccuucuacaagaaccucaucuggcucgucaagaagggcaacuccuaccccaagcucuccaacuccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccguccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgcccagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101109 - RNA, 1701 nt, Artificial Sequence; identical to SEQ ID NO: 98336
  derived and/or modified sequence opt2 from hemagglutinin__InfluenzaA__AFN20019

SEQ ID NO: 101110 - RNA, 1701 nt, Artificial Sequence; identical to SEQ ID NO: 97966
  derived and/or modified sequence opt2 from hemagglutinin__InfluenzaA__AFN20021

SEQ ID NO: 101111 - RNA, 1701 nt, Artificial Sequence; identical to SEQ ID NO: 98336
  derived and/or modified sequence opt2 from hemagglutinin__InfluenzaA__AFN20034

SEQ ID NO: 101112 - RNA, 1701 nt, Artificial Sequence; identical to SEQ ID NO: 98327
  derived and/or modified sequence opt2 from hemagglutinin__InfluenzaA__AFN20040

SEQ ID NO: 101113 - RNA, 1701 nt, Artificial Sequence; identical to SEQ ID NO: 101099
  derived and/or modified sequence opt2 from hemagglutinin__InfluenzaA__AFN20046

SEQ ID NO: 101114 - RNA, 1701 nt, Artificial Sequence; identical to SEQ ID NO: 98336
  derived and/or modified sequence opt2 from hemagglutinin__InfluenzaA__AFN20052

SEQ ID NO: 101115 - RNA, 1701 nt, Artificial Sequence; identical to SEQ ID NO: 98336
  derived and/or modified sequence opt2 from hemagglutinin__InfluenzaA__AFN20061

SEQ ID NO: 101116 - RNA, 1701 nt, Artificial Sequence
  derived and/or modified sequence opt2 from hemagglutinin__InfluenzaA__AFN20076
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgacugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaccggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101117 - RNA, 1701 nt, Artificial Sequence
  derived and/or modified sequence opt2 from hemagglutinin__InfluenzaA__AFN20081
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagaucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucaucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggccgcugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaccggcaacggcugcuucgaguucuaccacaagugcgacaacaccugcauggaguccgucaagaacggcaccuacgacuaccccaaguacuccgaggaggccaagcucaaccgcgaggucaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101118 - RNA, 1701 nt, Artificial Sequence; identical to SEQ ID NO: 98336
  derived and/or modified sequence opt2 from hemagglutinin__InfluenzaA__AFN20092

SEQ ID NO: 101119 - RNA, 1701 nt, Artificial Sequence; identical to SEQ ID NO: 101098
  derived and/or modified sequence opt2 from hemagglutinin__InfluenzaA__AFN20099

SEQ ID NO: 101120 - RNA, 1701 nt, Artificial Sequence
  derived and/or modified sequence opt2 from hemagglutinin__InfluenzaA__AFN20112
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcaagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacaaccccaacaagggcgucaccgccgccugcccccacgccggcgccaaguccuucuacaagaaccucaucuggcucgucaagaacggcaacuccuaccccaagcucaacaccuccuacaucaacgacaagggcaaggagguccucguccucuggggcauccaccaccccuccaccuccgccgaccagcagucccucuaccagaacgccgacgccuacgccuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacaccuccguccacgacugcaacaccaccugccagacccccaagggcgccaucaacaccucccuccccuuccagaacguccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccuucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaccaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101121 - RNA, 1701 nt, Artificial Sequence
  derived and/or modified sequence opt2 from hemagglutinin__InfluenzaA__AFN87924
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaccuccuacaucaacgacaagcgcaaggagguccucguccucuggggcauccaccaccccuccaccuccgccgaccagcagucccucuaccagaacgccgacgccuacgccuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacaccuccguccacgacugcaacaccaccugccagacccccaagggcgccaucaacaccucccuccccuuccagaacguccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccuucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101122 - RNA, 1701 nt, Artificial Sequence; identical to SEQ ID NO: 94181
  derived and/or modified sequence opt2 from hemagglutinin__InfluenzaA__AFN87926

SEQ ID NO: 101123 - RNA, 1701 nt, Artificial Sequence
  derived and/or modified sequence opt2 from hemagglutinin__InfluenzaA__AFN87927
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagcgcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccggcacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaaccgcgucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101124 - RNA, 1701 nt, Artificial Sequence
  derived and/or modified sequence opt2 from hemagglutinin__InfluenzaA__AFN87928
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccgcgagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgccgucucccucggcgccaucuccuucuggaugugcuccaacggcucccuccagugccgcaucugcaucuga

SEQ ID NO: 101125 - RNA, 1701 nt, Artificial Sequence; identical to SEQ ID NO: 95345
  derived and/or modified sequence opt2 from hemagglutinin__InfluenzaA__AFN87929

SEQ ID NO: 101126 - RNA, 1701 nt, Artificial Sequence; identical to SEQ ID NO: 95345
  derived and/or modified sequence opt2 from hemagglutinin__InfluenzaA__AFN87930

SEQ ID NO: 101127 - RNA, 1701 nt, Artificial Sequence
  derived and/or modified sequence opt2 from hemagglutinin__InfluenzaA__AFN87931
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggagaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcaguccaucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101128 - RNA, 1701 nt, Artificial Sequence
  derived and/or modified sequence opt2 from hemagglutinin__InfluenzaA__AFN87932
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccgcgagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccacaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101129 - RNA, 1701 nt, Artificial Sequence; identical to SEQ ID NO: 95345
  derived and/or modified sequence opt2 from hemagglutinin__InfluenzaA__AFN87933

SEQ ID NO: 101130 - RNA, 1701 nt, Artificial Sequence
  derived and/or modified sequence opt2 from hemagglutinin__InfluenzaA__AFN87934
augaaggccauccucgucgucaugcucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccagcucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101131 - RNA, 1701 nt, Artificial Sequence
  derived and/or modified sequence opt2 from hemagglutinin__InfluenzaA__AFN87936
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaucuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaccuccuacaucaacgacaagggcaaggagguccucguccucuggggcauccaccaccccuccaccuccgccgaccagcagucccucuaccagaacgccgacgccuacgccuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacaccuccguccacgacugcaacaccaccugccagacccccaagggcgccaucaacaccucccuccccuuccagaacguccaccccaucaccaucggcaagugccccaaguacgucaaguccaccaagcuccgccucgccaccggccuccgcaucguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccuucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101132 - RNA, 1701 nt, Artificial Sequence
  derived and/or modified sequence opt2 from hemagglutinin__InfluenzaA__AFN87938
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagaccuccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101133 - RNA, 1701 nt, Artificial Sequence
  derived and/or modified sequence opt2 from hemagglutinin__InfluenzaA__AFN87939
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaccuccuacaucaacgacaagggcaaggagguccucguccucuggggcauccaccaccccuccaccuccgccgaccagcagucccucuaccagaacgccgacgccuacgccuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacaccuccguccacgacugcaacaccaccugccagacccccaagggcgccaucaacaccucccuccccuuccagaacguccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101134 - RNA, 1701 nt, Artificial Sequence
  derived and/or modified sequence opt2 from hemagglutinin__InfluenzaA__AFN87941
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101135 - RNA, 1701 nt, Artificial Sequence
  derived and/or modified sequence opt2 from hemagglutinin__InfluenzaA__AFN87943
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaucuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaccuccuacaucaacgacaagggcaaggagguccucguccucuggggcauccaccaccccuccaccuccgccgaccagcagucccucuaccagaacgccgacgccuacgccuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacaccuccguccacgacugcaacaccaccugccagacccccaagggcgccaucaacaccucccuccccuuccagaacguccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101136 - RNA, 1701 nt, Artificial Sequence
  derived and/or modified sequence opt2 from hemagglutinin__InfluenzaA__AFN87945
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacgacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101137 - RNA, 1701 nt, Artificial Sequence
  derived and/or modified sequence opt2 from hemagglutinin__InfluenzaA__AFN87947
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaccuccuacaucaacgacaagggcaaggagguccucguccucuggggcauccaccaccccuccaccuccgccgaccagcagucccucuaccagaacgccgacgccuacgccuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacaccuccguccacgacugcaacaccaccugccagacccccaagggcgccaucaacaccucccuccccuuccagaacguccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccuucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101138 - RNA, 1701 nt, Artificial Sequence
  derived and/or modified sequence opt2 from hemagglutinin__InfluenzaA__AFN87949
augaaggccauccucgucgucaugcucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101139 - RNA, 1701 nt, Artificial Sequence; identical to SEQ ID NO: 98452
  derived and/or modified sequence opt2 from hemagglutinin__InfluenzaA__AFN87951

SEQ ID NO: 101140 - RNA, 1701 nt, Artificial Sequence
  derived and/or modified sequence opt2 from hemagglutinin__InfluenzaA__AFN87953
augaaggccauccucgucguccuccucuacaccuucgccaccgccaacgccgacacccucugcaucggcuaccacgccaacaacuccaccgacaccgucgacaccguccucgagaagaacgucaccgucacccacuccgccaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaccucaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101141 - RNA, 1701 nt, Artificial Sequence
  derived and/or modified sequence opt2 from hemagglutinin__InfluenzaA__AFN87955
augaaggccauccucgucgucaugcucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101142 - RNA, 1701 nt, Artificial Sequence
  derived and/or modified sequence opt2 from hemagglutinin__InfluenzaA__AFN87957
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaucuccgacaacggcaccugcuaccccggcgacuucaucgacuacgaggagcuccgcgagcagcucuccuccgucuccuccuucgagcgcuucgagaucuuccccaagaccuccuccuggcccaaccacgaccccaacaagggcgucaccgccgccugcccccacgccggcgccaaguccuucuacaagaaccucaucuggcucgucaagaagggcaacuccuaccccaagcucuccaccuccuacaucaacgacaagggcaaggagguccucguccucuggggcauccaccaccccuccaccuccgccgaccagcagucccucuaccagaacgccgacgccuacgccuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacaccuccguccacgacugcaacaccaccugccagacccccaagggcgccaucaacaccucccuccccuuccagaacguccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccuucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaagugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101143 - RNA, 1701 nt, Artificial Sequence
  derived and/or modified sequence opt2 from hemagglutinin__InfluenzaA__AFN87959
augaaggccauccucgucgucaugcucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101144 - RNA, 1701 nt, Artificial Sequence; identical to SEQ ID NO: 94666
  derived and/or modified sequence opt2 from hemagglutinin__InfluenzaA__AFN87961

SEQ ID NO: 101145 - RNA, 1698 nt, Artificial Sequence
  derived and/or modified sequence opt2 from hemagglutinin__InfluenzaA__AFO64802
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccgucaagaacggccucuaccccaaccucuccaaguccuacgucaacaacaagggcaaggagguccucguccucuggggcguccaccaccccuccaacauccgcgaccagcgcgccaucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 101146 - RNA, 1701 nt, Artificial Sequence
  derived and/or modified sequence opt2 from hemagglutinin__InfluenzaA__AFO64813
augaaggccaagcuccucguccuccucugcgccuucaccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaacugcuccaucgccggcuggauccucggcaaccccgagugcgagucccucuucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccaagggcgucaccgccuccugcucccacaagggccgcuccuccuucuaccgcaaccuccucuggcucaccgagaagaacggcuccuaccccaaccucuccaaguccuacgucaacaacaaggagaaggagguccucguccucuggggcguccaccaccccuccaacauccgcgaccagcgcgccaucuaccacaccgagaacgccuacgucuccgucgucuccucccacuacaaccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 101147 - RNA, 1701 nt, Artificial Sequence
  derived and/or modified sequence opt2 from hemagglutinin__InfluenzaA__AFO64824
augaaggccauccuccucguccuccucugcgccuucaccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaacugcuccaucgccggcuggauccucggcaaccccgagugcgagucccucuucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccaagggcgucaccgccuccugcucccacaagggccgcuccuccuucuaccgcaaccuccucuggcucaccgagaagaacggccucuaccccaaccucuccaaguccuacgucaacaacaaggagaaggagguccucguccucuggggcguccaccaccccuccaacaucggcgaccagcgcgccaucuaccacaccgagaacgccuacgucuccgucgucuccucccacuacaaccgccgcuucacccccgagaucgccaagcgccccaagguccgcggccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacgccaagugccagaccccccagggcgccaucaacuccucccuccccuuccagaacguccaccccgucaccaucggcgagugccccaaguacguccgcuccaccaagcucaagauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 101148 - RNA, 1701 nt, Artificial Sequence
  derived and/or modified sequence opt2 from hemagglutinin__InfluenzaA__AFO64835
augaaggccaagcuccucguccuccucugcgccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaacugcuccgucgccggcuggauccucggcaaccccgagugcgagucccucuucuccaaggaguccugguccuacaucgccgagacccccgaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccaagggcgucaccgccuccugcucccacaacggcaaguccuccuucuaccgcaaccuccucuggcucaccaagaagaacggccucuaccccaaccucuccaaguccuacgucaacaacaaggagaaggagguccucguccucuggggcguccaccaccccuccaacaucggcgagcagcgcgccaucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 101149 - RNA, 1701 nt, Artificial Sequence
  derived and/or modified sequence opt2 from hemagglutinin__InfluenzaA__AFO64846
augaaggccaagcuccucguccuccucugcgccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaacugcuccgucgccggcuggauccucggcaaccccgagugcgagucccucuucaccaaggaguccugguccuacaucgccgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccaagggcgucaccgccuccugcucccacaacggcaaguccuccuucuaccgcaaccuccucuggcucaccgagaagaacggccucuaccccaaccucuccaaguccuacgucaacaacaaggagaaggagguccucguccucuggggcguccaccaccccuccaacaugggcgaccagcgcgccaucuaccacaccgagaacgccuacgucuccgucgucuccucccacuacucccgccgcuucacccccgagaucgccaagcgccccaagguccgcggccaggagggccgcaucaacuacuacuggacccuccucgagcccggcgacaccaucaucuucgaggccaacggcaaccucaucgccccccgcuacgccuucgcccucucccgcggcuucggcuccggcaucaucaccuccaacgccuccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 101150 - RNA, 1701 nt, Artificial Sequence
  derived and/or modified sequence opt2 from hemagglutinin__InfluenzaA__AFO64857
augaaggccaagcuccucguccuccucugcgccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaccgccccccuccagcucggcaacugcuccgucgccggcuggauccucggcaaccccgagugcgagucccucuucuccaaggaguccugguccuacaucgccgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccaagggcgucaccgccuccugcucccacaacggcaaguccuccuucuacaagaaccuccucuggcucaccgagaagaacggccucuaccccaaccucuccaaguccuacgucaacaacaaggagaaggagguccucguccucuggggcguccaccaccccuccaacaucggcgaccagcgcgccaucuaccacaccgagaacgccuacgucuccgucgucuccucccacuacucccgccgcuucacccccgagaucgccaagcgccccaagguccgcggccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaccgccuccaugggcgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucgacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacggccgcacccucgacuuccacgacuccaacgucaagaaccucuacgagaaggucaagaaccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 101151 - RNA, 1701 nt, Artificial Sequence
  derived and/or modified sequence opt2 from hemagglutinin__InfluenzaA__AFO64868
augaaggucaagcuccucguccuccucugcgccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaccgccccccuccagcucggcaacugcuccgucgccggcuggauccucggcaaccccgagugcgagucccucuucuccaaggaguccugguccuacaucgccgagacccccaaccccgagaacggcaccugcuaccccggcugcuucgccgacuacgaggagcuccgcgagcagcucuccuccgucuccuccuucgagcgcuucgagaucuuccccaaggaguccuccuggcccaaccacaccgucaccaagggcgucaccgccuccugcucccacaacggcaaguccuccuucuacaagaaccuccucuggcucaccgagaagaacggccucuaccccaaccucuccaaguccuacgucaacaacaaggagaaggagguccucguccucuggggcguccaccaccccuccaacauccgcgaccagcgcgccaucuaccacaccgagaacgccuacgucuccgucgucuccucccacuacucccgccgcuucacccccgagaucgccaagcgccccaagguccgcggccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccaugggcgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucgacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 101152 - RNA, 1698 nt, Artificial Sequence
  derived and/or modified sequence opt2 from hemagglutinin__InfluenzaA__AFO64879
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagucccucaucuucaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccgagaagaacggccucuaccccaaccucuccaaguccuacgucaacaacaaggagaaggagguccucguccucuggggcguccaccaccccuccaacauccgcgaccagcgcgccaucuaccacaccgagaacgccuacgucuccgucgucuccucccacuacucccgccgcuucacccccgagaucgccaagcgccccaagguccgcggccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 101153 - RNA, 1698 nt, Artificial Sequence
  derived and/or modified sequence opt2 from hemagglutinin__InfluenzaA__AFO64890
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagucccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccgagaagaacggccucuaccccaaccucuccaaguccuacgucaacaacaaggagaaggagguccucguccucuggggcguccaccaccccuccaacauccgcgaccagcgcgccaucuaccacaccgagaacgccuacgucuccgucgucuccucccacuacucccgccgcuucacccccgagaucgccaagcgccccaagguccgcggccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgucaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 101154 - RNA, 1701 nt, Artificial Sequence
  derived and/or modified sequence opt2 from hemagglutinin__InfluenzaA__AFO64901
augaaggccaagcuccucguccuccucugcgccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaccgccccccuccagcucggcaacugcuccaucgccggcuggauccucggcaaccccgagugcgagucccucuucuccaaggaguccugguccuacaucgccgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccaagggcgucaccgccuccugcucccacaacggcaaguccuccuucuacaagaaccuccucuggcucaccgagaagaacggccucuaccccaaccucuccaaguccuacgucaacaacaagaagaaggagguccucguccucuggggcguccaccaccccuccaacaucggcgaccagcgcgccaucuaccacaccgagaacgccuacgucuccgucgucuccucccacuacucccgccgcuucacccccgagaucgccaagcgccccaagguccgcaaccaggagggccgcaucaacuacuacuggacccuccucgagcccggcgacaccaucaucuucgaggccaacggcaaccucaucgcccccugguacgccuucgcccucucccgcggcuucgaguccggcaucaucaccuccaacgccuccaugggcgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccaucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacaacgagugcauggaguccgucaagaacggcaccuacgacuaccccaaguacuccaaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 101155 - RNA, 1698 nt, Artificial Sequence
  derived and/or modified sequence opt2 from hemagglutinin__InfluenzaA__AFO65016
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagucccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccaagaagaacggccucuaccccaaccucuccaaguccuacgucaacaacaaggagaaggagguccucguccucuggggcguccaccaccccuccaacaucggcgaccagcgcaccaucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccaucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaaccucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 101156 - RNA, 1698 nt, Artificial Sequence; identical to SEQ ID NO: 93627
  derived and/or modified sequence opt2 from hemagglutinin__InfluenzaA__AFO65027

SEQ ID NO: 101157 - RNA, 1698 nt, Artificial Sequence
  derived and/or modified sequence opt2 from hemagglutinin__InfluenzaA__AFO65038
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccauguccuacgucaacaacaaggagaaggagguccucguccucuggggcguccaccacccccccaacaucggcaaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 101158 - RNA, 1698 nt, Artificial Sequence
  derived and/or modified sequence opt2 from hemagglutinin__InfluenzaA__AFO66136
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcaaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 101159 - RNA, 1701 nt, Artificial Sequence
  derived and/or modified sequence opt2 from hemagglutinin__InfluenzaA__AFO66147
augaaggccaagcuccucguccuccucugcgccuucaccaccaccuacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaccgccccccuccagcucggcaacugcuccaucgccggcuggauccucggcaaccccgagugcgagucccucuucuccaaggaguccugguccuacaucgccgagacccccaaccccaagaacggcaccugcuaccccggcuacuucgccgacuacgaggagcuccgcgagcagcucuccuccgucuccuccuucgagcgcuucgagaucuuccccaaggacuccuccuggcccaaccacaccgucaccaagggcgucaccgccuccugcucccacaacggcaaguccuccuucuacaagaaccuccucuggcucaccggcaagaacggccucuaccccaaccucuccaaguccuacgucaacaagaagggcaaggagguccucguccucuggggcguccaccaccccuccaacaugggcgaccagcgcgccaucuaccacaaggagaacgccuacgucuccguccucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaucuccaacgccuccaugggcgagugcgacgccaagugccagaccccccagggcgccaucaacuccucccuccccuuccagaacguccaccccgucaccaucggcgagugccccaaguacguccgcuccaccaagcuccgcauggucaccggccuccgcaacguccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccaucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcucaagaacaacgccaaggagaucggcaacggcugcuucgaguucuaccacaagugcaacaacgagugcauggaguccgucaagaacggcaccuacgacuaccccaaguacuccaaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 101160 - RNA, 1698 nt, Artificial Sequence
  derived and/or modified sequence opt2 from hemagglutinin__InfluenzaA__AFO66158
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaagggcuccugguccuacaucgucgagacccccaaccccgagaacggcaccugcuaccccggcuacuucgccgacuacgaggagcuccgcgagcagcucuccuccgucuccuccuucgagcgcuucgagaucuuccccaagggcuccuccuggcccaaccacaccgucaccggcgucuccgccuccugcucccacaacggcaaguccuccuucuaccgcaaccuccucuggcucaccggcaagaacggccucuaccccaaccucuccauguccuacgucaacaacaaggagaaggagguccucguccucuggggcguccaccacccccccaacaucggcaaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 101161 - RNA, 1698 nt, Artificial Sequence
  derived and/or modified sequence opt2 from hemagglutinin__InfluenzaA__AFO66169
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagaccuccaaccccgagaacggcaccugcuaccccggcuacuucaccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaccuccaacgcccccauggacgagugcgacgccaagugccagaccccccacggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 101162 - RNA, 1698 nt, Artificial Sequence
  derived and/or modified sequence opt2 from hemagglutinin__InfluenzaA__AFO66180
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaagggcuccuccuggcccaaccacaccgucaccggcgucuccgccuccugcucccacaacggcaaguccuccuucuaccgcaaccuccucuggcucaccggcaagaacggccucuaccccaaccucuccauguccuacgucaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcaaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 101163 - RNA, 1698 nt, Artificial Sequence
  derived and/or modified sequence opt2 from hemagglutinin__InfluenzaA__AFO66191
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaagggcuccuccuggcccaaccacaccgucaccggcgucuccgccuccugcucccacaacggcaaguccuccuucuaccgcaaccuccucuggcucaccggcaagaacggccucuaccccaaccucuccauguccuacgucaacaacaaggagaaggagguccucguccucuggggcguccaccacccccccaacaucggcaaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 101164 - RNA, 1698 nt, Artificial Sequence; identical to SEQ ID NO: 92024
  derived and/or modified sequence opt2 from hemagglutinin__InfluenzaA__AFO66202

SEQ ID NO: 101165 - RNA, 1698 nt, Artificial Sequence
  derived and/or modified sequence opt2 from hemagglutinin__InfluenzaA__AFO66213
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaagaagaaggagguccucguccucuggggcguccaccacccccccaacaucggcaaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 101166 - RNA, 1698 nt, Artificial Sequence
  derived and/or modified sequence opt2 from hemagglutinin__InfluenzaA__AFO66224
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcaaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 101167 - RNA, 1698 nt, Artificial Sequence
  derived and/or modified sequence opt2 from hemagglutinin__InfluenzaA__AFO66235
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuacaagaaccuccucuggcucaccggcaagaacggccucuaccccaaccucuccaaguccuacgccaacaacaaggagaaggagguccucguccucuggggcguccaccacccccccaacaucggcguccagcgcgcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 101168 - RNA, 1698 nt, Artificial Sequence
  derived and/or modified sequence opt2 from hemagglutinin__InfluenzaA__AFO66246
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuacaagaaccuccucuggcucaccggcaagaacggccucuaccccaaccucuccaaguccuacgccaacaacaaggagaaggagguccucguccucuggggcguccaccacccccccaacaucggcaaccagcgcgcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacgagugcgacgccgagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 101169 - RNA, 1701 nt, Artificial Sequence
  derived and/or modified sequence opt2 from hemagglutinin__InfluenzaA__AFP33324
augaaggccaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaccgccccccuccagcucggcaacugcuccaucgccggcuggauccucggcaaccccgagugcgagucccucuucuccaaggaguccugguccuacaucgccgagacccccaaccccaagaacggcaccugcuaccccggcuacuucgccgacuacgaggagcuccgcgagcagcucuccuccgucuccuccuucgagcgcuucgagaucuuccccaaggacuccuccuggcccaaccacaccgucaccaagggcgucaccgccuccugcucccacaacggcaaguccuccuucuacaagaaccuccucuggcucaccggcaagaacggccucuaccccaaccucuccaaguccuacgucaacaagaagggcaaggagguccucguccucuggggcguccaccaccccuccaacaugggcgaccagcgcgccaucuaccacaaggagaacgccuacgucuccguccucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaucuccaacgccuccaugggcgagugcgacgccaagugccagaccccccagggcgccaucaacuccucccuccccuuccagaacguccaccccgucaccaucggcgagugccccaaguacguccgcuccaccaagcuccgcauggucaccggccuccgcaacguccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccaucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagacccagcucaagaacaacgccaaggagaucggcaacggcugcuucgaguucuaccacaagugcaacaacgagugcauggaguccgucaagaacggcaccuacgacuaccccaaguacuccaaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 101170 - RNA, 1698 nt, Artificial Sequence
  derived and/or modified sequence opt2 from hemagglutinin__InfluenzaA__AFP33325
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucauccccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccucccacaccgucaccggcgucuccgccuccugcucccacaacggcaaguccuccuucuaccgcaaccuccucuggcucaccggcaagaacggccucuaccccaaccucuccaaguccuacuccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcggccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 101171 - RNA, 1701 nt, Artificial Sequence
  derived and/or modified sequence opt2 from hemagglutinin__InfluenzaA__AFQ32573
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucggcgacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101172 - RNA, 1701 nt, Artificial Sequence
  derived and/or modified sequence opt2 from hemagglutinin__InfluenzaA__AFQ37281
augaaggccauccucgucguccuccucuacaccuucgccaccaccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccaccgaccagcagucccucuaccagaacgccgacgccuacgucuucgucggcaccucccgcuacuccaagaaguucaagcccgagaucgccauccgccccaagguccgcgaccgcgagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccgcccacgacugcaacaccaccugccagacccccaagggcgccaucaacaccucccuccccuuccagaacguccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacgacaagugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 101173 - RNA, 1707 nt, Artificial Sequence
  derived and/or modified sequence opt2 from hemagglutinin__InfluenzaA__AFQ55689
augaacacccagauccucgcccucaucgccugcaugcucaucggcgccaagggcgacaagaucugccucggccaccacgccgucgccaacggcaccaaggucaacacccucaccgagcgcggcaucgaggucgucaacgccaccgagaccgucgagaccgccaacaccaagaagaucugcacccagggcaagcgccccaccgaccucggccagugcggccuccucggcacccucaucggccccccccagugcgaccaguuccucgaguucgacgccgaccucaucaucgagcgccgcgagggcaccgacgucugcuaccccggcaaguucaccaacgaggagucccuccgccagauccuccgcggcuccggcggcaucgacaaggaguccaugggcuucaccuacuccggcauccgcaccaacggcgccaccuccgccugccgccgcuccggcuccuccuucuacgccgagaugaaguggcuccucuccaacuccgacaacgccgccuucccccagaugaccaaguccuaccgcaacccccgcaacaagcccgcccucaucaucuggggcguccaccacuccggcuccgccaccgagcagaccaagcucuacggcuccggcaacaagcucaucaccgucggcuccuccaaguaccagcaguccuucacccccucccccggcgcccgcccccaggucaacggccaguccggccgcaucgacuuccacuggcuccuccucgaccccaacgacaccgucaccuucaccuucaacggcgccuucaucgcccccgaccgcgccuccuucuuccgcggcgaguccaucggcguccaguccgacgucccccucgacuccggcugcgagggcgacugcuuccacaacggcggcaccaucgucuccucccuccccuuccagaacaucaacccccgcaccgucggcaagugcccccgcuacgucaagcagaccucccuccuccucgccaccggcaugcgcaacguccccgagaaccccaaggaccgcaagucccgccaccgccgcacccgcggccucuucggcgccaucgccggcuucaucgagaacggcugggagggccucaucgacggcugguacggcuuccgccaccagaacgcccagggcgagggcaccgccgccgacuacaaguccacccaguccgccaucgaccagaucaccggcaagcucaaccgccucaucgacaagaccaaccagcaguucgagcucaucgacaacgaguucuccgagaucgagcagcagaucggcaacgucaucaacuggacccgcgacuccaugaccgaggucugguccuacaacgccgagcuccucgucgccauggagaaccagcacaccaucgaccucgccgacuccgagaugaacaagcucuacgagcgcguccgcaagcagcuccgcgagaacgccgaggaggacggcaccggcugcuucgagaucuuccacaagugcgacgaccagugcauggaguccauccgcaacaacaccuacgaccacacccaguaccgcgccgagucccuccagaaccgcauccagaucgaccccgucaagcucuccuccggcuacaaggacaucauccucugguucuccuucggcgccuccugcuuccuccuccucgccaucgccaugggccucgucuucaucugcaucaagaacggcaacaugcgcugcaccaucugcaucuga

SEQ ID NO: 101174 - RNA, 1701 nt, Artificial Sequence; identical to SEQ ID NO: 99698
  derived and/or modified sequence opt2 from hemagglutinin__InfluenzaA__AFR68153

SEQ ID NO: 101175 - RNA, 1701 nt, Artificial Sequence
  derived and/or modified sequence opt2 from hemagglutinin__InfluenzaA__AFR68163
augaaggccacccucgucguccuccucuacaccuucgccaccgccaacgccgacacccucugcaucggcuaccacgccaacaacuccaccgacaccgucgacaccguccucgagaagaacgucaccgucacccacuccgccaaccuccucgaggacaagcacaacggcaagcucugcaagcuccgcggcgucgccccccuccaccucggcaagugcaacaucgccggcuggauccucggcaaccccgagugcgagacccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcgacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 101176 - RNA, 1701 nt, Artificial Sequence
  derived and/or modified sequence opt2 from hemagglutinin__InfluenzaA__AFR68173
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaguccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101177 - RNA, 1701 nt, Artificial Sequence; identical to SEQ ID NO: 94181
  derived and/or modified sequence opt2 from hemagglutinin__InfluenzaA__AFR84675

SEQ ID NO: 101178 - RNA, 1701 nt, Artificial Sequence; identical to SEQ ID NO: 94534
  derived and/or modified sequence opt2 from hemagglutinin__InfluenzaA__AFR84685

SEQ ID NO: 101179 - RNA, 1701 nt, Artificial Sequence; identical to SEQ ID NO: 94361
  derived and/or modified sequence opt2 from hemagglutinin__InfluenzaA__AFR84694

SEQ ID NO: 101180 - RNA, 1701 nt, Artificial Sequence; identical to SEQ ID NO: 94168
  derived and/or modified sequence opt2 from hemagglutinin__InfluenzaA__AFR84704

SEQ ID NO: 101181 - RNA, 1701 nt, Artificial Sequence
  derived and/or modified sequence opt2 from hemagglutinin__InfluenzaA__AFR84714
augaaggccauccucgucguccuccucuacaccuucgccaccgccaacgccgacacccucugcaucggcuaccgcgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101182 - RNA, 1701 nt, Artificial Sequence; identical to SEQ ID NO: 94361
  derived and/or modified sequence opt2 from hemagglutinin__InfluenzaA__AFR84724

SEQ ID NO: 101183 - RNA, 1701 nt, Artificial Sequence; identical to SEQ ID NO: 94361
  derived and/or modified sequence opt2 from hemagglutinin__InfluenzaA__AFR84734

SEQ ID NO: 101184 - RNA, 1701 nt, Artificial Sequence; identical to SEQ ID NO: 94361
  derived and/or modified sequence opt2 from hemagglutinin__InfluenzaA__AFR84754

SEQ ID NO: 101185 - RNA, 1701 nt, Artificial Sequence; identical to SEQ ID NO: 94361
  derived and/or modified sequence opt2 from hemagglutinin__InfluenzaA__AFR84764

SEQ ID NO: 101186 - RNA, 1701 nt, Artificial Sequence; identical to SEQ ID NO: 94361
  derived and/or modified sequence opt2 from hemagglutinin__InfluenzaA__AFR84774

SEQ ID NO: 101187 - RNA, 1701 nt, Artificial Sequence
  derived and/or modified sequence opt2 from hemagglutinin__InfluenzaA__AFR84784
augaaggccauccucgucggccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucgcccucgucgucucccucggcgccaucuccuucuggaugugcuccaacggcucccuccagugccgcaucugcaucuga

SEQ ID NO: 101188 - RNA, 1701 nt, Artificial Sequence; identical to SEQ ID NO: 94361
  derived and/or modified sequence opt2 from hemagglutinin__InfluenzaA__AFR84794

SEQ ID NO: 101189 - RNA, 1701 nt, Artificial Sequence; identical to SEQ ID NO: 94181
  derived and/or modified sequence opt2 from hemagglutinin__InfluenzaA__AFR84804

SEQ ID NO: 101190 - RNA, 1701 nt, Artificial Sequence; identical to SEQ ID NO: 94361
  derived and/or modified sequence opt2 from hemagglutinin__InfluenzaA__AFR84814

SEQ ID NO: 101191 - RNA, 1701 nt, Artificial Sequence; identical to SEQ ID NO: 94181
  derived and/or modified sequence opt2 from hemagglutinin__InfluenzaA__AFR84824

SEQ ID NO: 101192 - RNA, 1701 nt, Artificial Sequence; identical to SEQ ID NO: 94207
  derived and/or modified sequence opt2 from hemagglutinin__InfluenzaA__AFR84834

SEQ ID NO: 101193 - RNA, 1701 nt, Artificial Sequence; identical to SEQ ID NO: 99381
  derived and/or modified sequence opt2 from hemagglutinin__InfluenzaA__AFR84844

SEQ ID NO: 101194 - RNA, 1701 nt, Artificial Sequence; identical to SEQ ID NO: 94423
  derived and/or modified sequence opt2 from hemagglutinin__InfluenzaA__AFR84854

SEQ ID NO: 101195 - RNA, 1701 nt, Artificial Sequence; identical to SEQ ID NO: 94181
  derived and/or modified sequence opt2 from hemagglutinin__InfluenzaA__AFR84864

SEQ ID NO: 101196 - RNA, 1701 nt, Artificial Sequence; identical to SEQ ID NO: 94361
  derived and/or modified sequence opt2 from hemagglutinin__InfluenzaA__AFR84874

SEQ ID NO: 101197 - RNA, 1701 nt, Artificial Sequence; identical to SEQ ID NO: 94168
  derived and/or modified sequence opt2 from hemagglutinin__InfluenzaA__AFR84893

SEQ ID NO: 101198 - RNA, 1701 nt, Artificial Sequence; identical to SEQ ID NO: 94168
  derived and/or modified sequence opt2 from hemagglutinin__InfluenzaA__AFR84903

SEQ ID NO: 101199 - RNA, 1701 nt, Artificial Sequence; identical to SEQ ID NO: 94168
  derived and/or modified sequence opt2 from hemagglutinin__InfluenzaA__AFR84913

SEQ ID NO: 101200 - RNA, 1701 nt, Artificial Sequence; identical to SEQ ID NO: 94168
  derived and/or modified sequence opt2 from hemagglutinin__InfluenzaA__AFR84923

SEQ ID NO: 101201 - RNA, 1689 nt, Artificial Sequence
  derived and/or modified sequence opt2 from hemagglutinin__InfluenzaA__AFV53205
auggccaucaucuaccucauccuccucuucgccaccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccuccgcguccccgagugguccuacaucauggagaaggagaacccccgcuacucccucugcuaccccggcucccucaacgacuacgaggagcucaagcaccuccucuccuccguccgccacuucgagaagguccgcauccuccccaaggaccgcuggacccagcacaccaccaccggcgacuccaaggccugcgccgucuccggcaagcccuccuucuuccgcaacauggucuggcucaccaagaagggccccgacuaccccgucgccaagggcuccuacaacaacaccuccggcgagcagaugcucaucaucuggggcguccaccaccccaucgacgaggccgagcagcgcgagcucuaccagaaggucggcaccuacgucuccgccuccaccuccacccucaacaagcgcuccauccccgagaucgccgcccgccccgaggucaacggccuccgcucccgcauggaguucuccuggacccuccucgacgucugggacaccaucaacuucgaguccaccggcaaccucaucgcccccgaguacggcuucaagaucuccaagcgcggcuccuccggcaucaugaagaccgagggcacccucggcaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacgagaucaccaacaaggucaacuccgucaucgagaagaugaacacccaguucgaggccgucggcaaggaguucaacaaccucgagaagcgccucgagaaccucaacaagaagauggaggacggcuuccucgacgucuggaccuacaacgccgagcuccucguccucauggagaacgagcgcacccucgacuuccacgacuccaacgucaagaaccucuacgagaagguccgcaugcagcuccgcgacaacgucaaggagcucggcaacggcugcuucgaguucuaccacaagugcgacgacgagugcaucaacuccgucaagaacggcaccuacgacuaccccaaguacgaggaggaguccaagcucaagcgcaacgagaucaagggcgucaagcucuccuccaugggcgucuaccagauccucgccaucuacgccaccgucgccggcucccucucccucgccaucaugauggccggcaucuccuucuggaugugcuccaacggcucccuccagugccgcaucugcaucuga

SEQ ID NO: 101202 - RNA, 1689 nt, Artificial Sequence
  derived and/or modified sequence opt2 from hemagglutinin__InfluenzaA__AFV53216
auggccaucaucuaccucauccuccucuucaccgccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccucuccguccccgagugguccuacaucauggagaaggagaacccccgcgacggccucugcuaccccggcuccuucaacgacuacgaggagcucaagcaccuccucuccuccgucaagcacuucgagaaggucaagauccuccccaaggaccgcuggacccagcacaccaccaccggcggcucccgcgccugcgccgucuccggcaaccccuccuucuuccgcaacauggucuggcucaccgagaagggcuccaacuaccccgucgccaagggcuccuacaacaacaccuccggcgagcagaugcucaucaucuggggcguccaccaccccaacgacgagaccgagcagcgcacccucuaccagaacgucggcaccuacgucuccgucggcaccuccacccucaacaagcgcuccacccccgacaucgccacccgccccaaggucaacggccagggcggccgcauggaguucuccuggacccuccucgacaugugggacaccaucaacuucgaguccaccggcaaccucaucgcccccgaguacggcuucaagaucuccaagcgcggcuccuccggcaucaugaagaccgagggcacccucggcaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacggcaucaccaacaaggucaacuccgucaucgagaagaugaacacccaguucgaggccgucgagaaggaguucuccaaccucgagcgccgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaaccgcaacgagaucaagggcgucaagcucuccuccaugggcaucuaccagauccucgccaucuacgccaccgucgccggcucccucucccucgccaucaugauggccggcaucuccuucuggaugugcuccaacggcucccuccagugccgcaucugcaucuga

SEQ ID NO: 101203 - RNA, 1689 nt, Artificial Sequence
  derived and/or modified sequence opt2 from hemagglutinin__InfluenzaA__AFV53227
augaucaucaucuaccucauccuccucuucaccgccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccuccgcguccccgagugguccuacaucauggagaaggagaacccccgcuacucccucugcuaccccggcuccuucaacgacuacgaggagcucaagcaccuccucuccuccgucaagcacuucgagaaggucaagauccuccccaaggacggcuggacccagcacaagaccgacggcggcuccaaggccugcgccgucuccggcaaggccuccuucuuccgcaacauggucuggcucaccaaggagggccccaacuaccaggucgccaagcgcuccuacaacaacaccuccggcgagcagaugcucaucaucuggggcguccaccaccccaaggacgaggccgagcagaucgcccucuaccagaaggucggcaccuacgucuccgccuccaccuccacccucaacaagcgcuccacccccgagaucgccgcccgccccgaggucaacggccucggcucccgcauggaguucuccuggacccuccucgacgucugggacaccaucaacuucgaguccaccggcaaccucgucgcccccgaguacggcuucaagaucuccaagcgcggcuccuccggcaucaugaagaccgagggcacccucggcaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgaccgcaucaccaacaaggucaacuccgucaucgagaagaugaacauccaguucgaggccgucggcaaggaguucuccaaccucgagaagcgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaagcgcaacgagaucaagggcgucaagcucuccuccaugggcgucuaccagauccucgccaucuacgccaccgucgccggcucccucucccucgccaucaugaucgccggcaucuccuucuggaugugcuccaacggcucccuccagugccgcgucugcaucuga

SEQ ID NO: 101204 - RNA, 1689 nt, Artificial Sequence
  derived and/or modified sequence opt2 from hemagglutinin__InfluenzaA__AFV53238
auggccaucaucuaccucauccuccucuucaccgccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccuccgcguccccgagugguccuacaucauggagaaggagaacccccgcuacucccucugcuaccccggcuccuucaacgacuacgaggagcucaagcaccuccucuccuccgucaagcacuucgagaaggucaagauccuccccaaggaccgcuggacccagcacaccaccaccggcggcuccauggccugcgccgucuccggcaagcccuccuucuuccgcaacauggucuggcucaccaccaagggccccaacuaccccgucgcccagggcuccuacaacaacaccuccggcgagcagaugcucaucaucuggggcguccaccaccccaacgacgaggccgagcagcgcgcccucuaccagaaggucggcaccuacgucuccgccuccaccuccacccucuacaagcgcuccauccccgagaucgccgcccgccccaaggucaacggccucggcucccgcauggaguucuccuggacccuccucgacaugugggacaccaucaacuucgaguccaccggcaaccucgucgcccccgaguacggcuucaagaucuccaagcgcggcuccuccggcaucaugaagaccgagggcacccucgagaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacggcaucaccaacaaggucaacuccgucaucgagaagaugaacacccaguucgaggccgucggcaaggaguucuccaaccucgagaagcgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacaacgagugcauggacuccgucaagaacggcaccuacgacuaccccaaguacgaggaggaguccaagcucaaccgcaacgagaucaagggcgucaagcucuccuccaugggcgucuaccagauccucgccaucuacgccaccgucgccggcucccucucccucgccaucaugauggccggcaucuccuucuggaugugcuccaacggcucccuccagugccgcaucugcaucuga

SEQ ID NO: 101205 - RNA, 1689 nt, Artificial Sequence
  derived and/or modified sequence opt2 from hemagglutinin__InfluenzaA__AFV53249
auggccaucaucuaccucauccuccucuucgccaccguccgcggcgaccagaucugcaucggcuaccacgccaacaacuccaccgagaccgucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccuccgcguccccgagugguccuacaucauggagaaggagaacccccgcuacucccucugcuaccccggcucccucaacgacuacgaggagcucaagcaccuccucuccuccgucaagcacuucgagaagguccgcauccuccccaaggaccgcuggaccaaccacaccaccaccggcggcuccaaggccugcgccgucuccggcgagcccuccuucuuccgcaacauggucuggcucaccaagaagggccccaacuaccccgucgccaagggcuccuacaacaacaccuccggcgagcagaugcucaucaucuggggcguccaccaccccaacgacgaggccgagcagcgcgcccucuaccagaaggucggcaccuacgucuccgccuccaccuccacccucuacaagcgcuccauccccgagaucgccgcccgccccaaggucaacggccucggcucccgcauggaguucuccuggacccuccucaacgucugggacaccaucaacuucgaguccaccggcaaccucgucgcccccgaguacggcuucaagaucuccaagcgcggccgcuccggcaucaugaagaccgagggcacccucggcaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacggcaucaccaacaaggucaacuccgucaucgagaagaugaacacccaguucgaggccgucggcaaggaguucaacaaccucgagaagcgccucgagaaccucaacaagaagauggaggacggcuuccucgacgucuggaccuacaacgccgagcuccucguccucauggagaacgagcgcacccucgacuuccacgacuccaacgucaagaaccucuacgagaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaagcgcaacgagaucaagggcgucaagcucuccuccaugggcgucuaccagauccucgccaucuacgccaccgucgccggcucccucucccucgccaucauggucgccggcaucuccuucuggaugugcuccaacggcucccuccagugccgcaucugcaucuga

SEQ ID NO: 101206 - RNA, 1698 nt, Artificial Sequence
  derived and/or modified sequence opt2 from hemagglutinin__InfluenzaA__AFV53260
augaaggccaagcuccucauccuccucugcgcccucuccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaaggccccccuccagcucggcaacugcaacaucgccggcuggguccucggcaaccccgagugcgagucccuccucuccaaccgcuccugguccuacaucgccgagacccccaacuccgagaacggcaccugcuaccccggcgacuucgccgacuacgaggagcuccgcgagcagcucuccuccgucuccuccuucgagcgcuucgagaucuuccccaaggagcgcuccuggcccaaccacaccacccgcggcgucaccgccgccugcccccacgccaugaaguccuccuucuacaagaaccucgucuggcucaccgaggccaacggcuccuaccccaaccucucccgcuccuacgucaacaaccaggagaaggagguccucguccucuggggcguccaccaccccuccaacaucgaggaccagcgcacccucuaccgcaaggacaacgccuacgucuccgucgucuccuccaacuacaaccgccgcuucacccccgagaucgccaagcgccccaagguccgcggccaguccggccgcaucaacuacuacuggacccuccucgagcccggcgacaccaucaucuucgaggccaccggcaaccucaucgcccccugguacgccuucgcccucucccgcggccccggcuccggcaucaucaccuccaacgccccccucgacgagugcgacaccaagugccagaccccccagggcgccaucaacuccucccuccccuuccagaacauccaccccgucaccaucggcgagugccccaaguacguccgcuccaccaagcuccgcauggucaccggccuccgcaacauccccuccuuccagucccgcggccucuucggcgccaucgccggcuucaucgagggcggcuggaccggcaugauggacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcuccgcaacaacgccaaggagcucggcaacggcugcuucgaguucuaccacaagugcgacaacgagugcauggaguccgucaagaacggcaccuacgacuaccccaaguacuccgaggaguccaagcucaaccgcgagaagaucgacggcgucaagcucgaguccaugggcgucuaccgcauccucgccaucuacuccaccgucgccuccucccucguccuccucgucucccucggcgccaucuccuucuggaugugcuccaacggcucccuccagugccgcaucugcaucuga

SEQ ID NO: 101207 - RNA, 1689 nt, Artificial Sequence
  derived and/or modified sequence opt2 from hemagglutinin__InfluenzaA__AFV53271
auggccaucaccuaccucauccuccucuucaccgccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgcuuccuccgcguccccgagugguccuacaucauggagaaggagaacccccgcuacucccucugcuaccccggcuccuucaacgacuacgaggagcucaagcaccuccucuccuccgucaagcacuucgagaaggucaagauccuccccaaggacggcuggacccagcacaccaccaccggcggcuccauggccugcgccgucuccggcaagcccuccuucuuccgcaacauggucuggcucaccgagaagggccagaacuaccccgucgccaagggcuccuacaacaacaccuccggcgagcagaugcucaucaucuggggcguccaccaccccaacgacgaggccgagcagcgcgcccucuaccagaaggucggcaccuacgucuccgccuccaccuccacccucaacaagcgcuccacccccgagaucgccgcccgccccaaggucaacggccucggcucccgcauggaguucuccuggacccuccucgacaugugggacaccaucaacuucgaguccaccggcaaccucgucgcccccgaguacggcuucaagaucuccaagcgcggcuccuccggcaucaugaagaccgagggcacccucgagaacugcgagaccaagugccagaccccccucggcgccaucaacaccacccuccccuuccacaacguccacccccucaccaucggcgagugccccaaguacgucaaguccgagaagcucguccucgccaccggccuccgcaacaucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacggcaucaccaacaaggucaacuccgucaucgagaagaugaacacccaguucgaggccgucggcaaggaguucuccaaccucgagaagcgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacaacgagugcauggacuccgucaagaacggcaccuacgacuaccccaaguacgaggaggaguccaagcucaaccgcaacgagaucaagggcgucaagcucuccuccaugggcgucuaccagauccucgccaucuacgccaccgucgccggcucccucucccucgccaucaugauggccggcaucuccuucuggaugugcuccaacggcucccuccagugccgcaucugcaucuga

SEQ ID NO: 101208 - RNA, 1689 nt, Artificial Sequence
  derived and/or modified sequence opt2 from hemagglutinin__InfluenzaA__AFV53282
auggccaucaucuaccucauccuccucuucaccgccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccucuccguccccgagugguccuacaucauggagaaggagaacccccgcgacggccucugcuaccccggcuccuucaacgacuacgaggagcucaagcaccuccucuccuccgucaagcacuucgagaaggucaagauccuccccaaggaccgcuggacccagcacaccaccaccggcggcucccgcgccugcgccgucuccggcaaccccuccuucuuccgcaacauggucuggcucaccaagaagggcaccaacuaccccgucgccaagggcuccuacaacaacaccuccggcgagcagaugcucaucaucuggggcguccaccaccccaacgacgagaccgagcagcgcacccucuaccagaacgucggcaccuacgucuccgucggcaccuccacccucaacaagcgcuccacccccgagaucgccacccgccccaaggucaacggccucggcucccgcauggaguucuccuggacccuccucgacaugugggacaccaucaacuucgaguccaccggcaaccucaucgcccccgaguacggcuucaagaucuccaagcgcggcuccuccggcaucaugaagaccgagggcacccucgagaacugcgagaccaagugccagaccccccucggcgccaucaacaccacccuccccuuccacaacguccacccccucaccaucggcgagugccccaaguacgucaagcucgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacgucaucaccaacaaggucaacuccgucaucgagaagaugaacacccaguucgaggccgucggcaaggaguucuccaaccucgagcgccgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaaccgcaacgagaucaagggcgucaagcucuccuccaugggcgucuaccagauccucgccaucuacgccaccgucgccggcucccucucccucgccaucaugauggccggcaucuccuucuggaugugcuccaacggcucccuccagugccgcaucugcaucuga

SEQ ID NO: 101209 - RNA, 1689 nt, Artificial Sequence
  derived and/or modified sequence opt2 from hemagglutinin__InfluenzaA__AFV53293
auggccaucaucuaccucauccuccucuucaccuccguccgcggcgaccagaucugcaucggcuaccacgccaacaacuccaccgagaaggucgacaccauccucgagcgcaacgucaccgucacccacgccaagaacauccucgagaagacccacaacggcaagcucugcaagcucaacggcauccccccccucgagcucggcgacugcuccaucgccggcuggcuccucggcaaccccgagugcgaccgccuccuccgcguccccgagugguccuacaucauggagaaggagaaccccaaguacucccucugcuaccccggcuccuucaacgacuacgaggagcucaagcaccuccucuccuccgucaagcacuucgagaaggucaagauccuccccaaggacggcuggacccagcacaccaccaacggcggcucccgcgccugcgccgucuccggcaaccccuccuucuuccgcaacauggucuggcucaccaagaagggccccaacuaccccgucgccaagggcuccuacaacaacaccuccggcgagcagaugcucaucaucuggggcguccaccaccccaacgacgaggccgagcagcgcgcccucuaccaggaggucggcaccuacgucuccgccuccaccuccacccucaacaagcgcuccacccccgagaucgccgcccgccccaaggucaacggccucggcucccgcauggaguucuccuggacccuccucgacaugugggacaccaucaacuucgaguccaccggcaaccucgucgcccccgaguacggcuucaagaucuccaagcgcggcuccuccggcgucaugaagaccgagggcacccucgagaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacggcaucaccaacaaggucaacuccgucaucgagaagaugaacacccaguucgaggccgucggcaaggaguucuccaaccucgagaagcgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacgacgagugcauggacuccgucaagaacggcaccuacgacuaccccaaguacgaggaggaguccaagcucaaccgcaacgagaucaagggcgucaagcucuccuccaugggcgucuaccagauccucgccaucuacgccaccgucgccggcucccucucccucgccaucaugauggccggcaucuccuucuggaugugcuccaacggcucccuccagugccgcaucugcaucuga

SEQ ID NO: 101210 - RNA, 1689 nt, Artificial Sequence
  derived and/or modified sequence opt2 from hemagglutinin__InfluenzaA__AFV53304
auggccaucaucuaccucauccuccucuucaccgccguccgcggcgaccagaucugcaucggcuaccacgccaacaacuccaccgagaaggucgacaccauccucgagcagaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccucuccguccccgagugguccuacaucauggagaaggagaacccccgcgacggccucugcuaccccggcuccuucaacgacuacgaggagcucaagcaccuccucuccuccgucaagcacuucgagaaggucaagauccuccccaaggaccgcuggacccagcacaccaccaccggcggcucccgcgccugcgccgucuccggcaaccccuccuucuuccgcaacauggucuggcucaccaagaaggaguccaacuaccccgucgccaagggcuccuacaacaacaccuccggcgagcagaugcucaucaucuggggcguccaccaccccaacgacgagaccgagcagcgcacccucuaccagaacgucggcaccuacgucuccgucggcaccuccacccucaacaagcgcuccacccccaacaucgccacccgccccaaggucaacggccucggcucccgcauggaguucuccuggacccuccucgacaugugggacaccaucaacuucgaguccaccggcaaccucaucgcccccgaguacggcuucaagaucuccaagcgcggcuccuccggcaucaugaagaccgagggcacccucgagaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacggcaucaccaacaaggucaacuccgucaucgagaagaugaacacccaguucgaggccgucggcaaggaguucuccaaccucgagcgccgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaaccgcaacgagaucaagggcgucaagcucuccuccaugggcgucuaccagauccucgccaucuacgccaccgucgccggcucccucucccucgccaucaugauggccggcaucuccuucuggaugugcuccaacggcucccuccagugccgcaucugcaucuga

SEQ ID NO: 101211 - RNA, 1689 nt, Artificial Sequence
  derived and/or modified sequence opt2 from hemagglutinin__InfluenzaA__AFV53314
auggccaucaucuaccucauccuccucuucaccgccguccgcggcgacaagaucugcaucggcuaccacgccaacaacuccaccgagaccgucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccucuccguccccgagugguccuacaucauggagaaggagaacccccgcaacggccucugcuaccccggcaacuucaacgacuacgaggagcucaagcaccuccucuccuccgucaagcacuucgagaaggucaagauccuccccaaggaccgcuggacccagcacaccaccaccggcggcucccaggccugcgccgucuccggcaaccccuccuucuuccgcaacauggucuggcucaccgagaaggaguccaacuaccccgucgccaagggcuccuacaacaacaccuccggcgagcagaugcucaucaucuggggcguccaccaccccaucgacgagaccgagcagcgcacccucuaccagaacgucggcaccuacgucuccgucggcaccuccacccucaacaagcgcuccacccccgagaucgccaagcgccccaaggucaacggccucggcucccgcauggaguucuccuggacccuccucgacaugugggacaccaucaccuucgaguccaccggcaaccucaucgcccccgaguacggcuucaagaucuccaagcgcggcuccuccggcaucaugaagaccgagggcacccucgagaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacggcaucaccaacaaggucaacgccgucaucgagaagaucaacacccaguucgaggccgucggcaaggaguucuccaaccucgagcgccgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaaccgcaacgagaucaagggcgucaagcucuccuccaugggcgucuaccagauccucgccaucuacgccaccgucgccggcucccucucccucgccaucaugauggccggcaucuccuucuggaugugcuccaacggcucccuccagugccgcaucugcaucuga

SEQ ID NO: 101212 - RNA, 1689 nt, Artificial Sequence
  derived and/or modified sequence opt2 from hemagglutinin__InfluenzaA__AFV53325
auggccaucaucuaccucauccuccucuucaccgccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccucuccguccccgagugguccuacaucauggagaaggagaacccccgcgacggccucugcuaccccggcuccuucaacgacuacgaggagcucaagcaccuccucuccuccgucaagcacuucgagaaggucaagauccuccccaaggaccgcuggacccagcacaccaccaccggcggcucccgcgccugcgccgucuccggcaaccccuccuucuuccgcaacauggucuggcucaccaagaagggcuccaacuacaccgucgccaagggcuccuacaacaacaccuccggcgagcagaugcucaucaucuggggcguccaccaccccaacgacgagaccgagcagcgcacccucuaccagaacgucggcaccuacgucuccgucuccaccuccacccucaacaagcgcuccacccccgagaucgccacccgccccaaggucaacggccucggcucccgcauggaguucuccuggacccuccucgacaugugggacaccaucaacuucgaguccaccggcaaccucaucgcccccgaguacggcuucaagaucuccaagcgcggcuccuccggcaucaugaagaccgagggcacccucgagaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgacggcaucaccaacaaggucaacuccgucaucgagaagaugaacacccaguucgaggccgucggcaaggaguucuccaaccucgagcgccgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaaccgcaacgagaucaagggcgucaagcucuccuccaugggcgucuaccagauccucgccaucuacgccaccgucgccggcucccucucccucgccaucaugauggccggcaucuccuucuggaugugcuccaacggcucccuccagugccgcaucugcaucuga

SEQ ID NO: 101213 - RNA, 1689 nt, Artificial Sequence
  derived and/or modified sequence opt2 from hemagglutinin__InfluenzaA__AFV53336
auggccaucaucuaccucauccuccucuucaccgccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccuccgcguccccgagugguccuacaucauggagaaggagaacccccgcuacucccucugcuaccccggcuccuucaacgacuacgaggagcucaagcaccuccucuccuccgucaagcaccucgagaaggucaagauccuccccaaggacggcuggacccagcacgagaccgacggcggcuccaaggccugcgccgucuccggcaagcccuccuucuuccgcaacauggucuggcucaccaagaagggccccaacuaccccgucgccaagcgcuccuacaacaacaccuccggcgagcagaugcucaucaucuggggcguccaccaccccaacgacgaggccgagcagcgcgcccucuaccagaaggucggcaccuacgucuccgccuccaccuccacccucaacaagcgcuccacccccgagaucgccgcccgccccgaggucuccggccucggcucccgcauggaguucuccuggacccuccucgacgucugggacaccaucuccuucgaguccaccggcaaccucgucgcccccgaguacggcuucaagaucuccaagcgcggcuccuccggcaucaugaagaccgagggcacccucggcaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgaccgcaucaccaacaaggucaacuccgucaucgagaagaugaacacccaguucgaggccgucggcaaggaguucuccaaccucgagaagcgccucgagaaccucaacaagaagauggaggacggcuuccucgacgucuggaccuacaacgccgagcuccucguccucauggagaacgagcgcauccucgacuuccacgacuccaacgucaagaaccucuacgacaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaagcgcaacgagaucaagggcgucaagcucuccuccaugggcgucuaccagauccucgccaucuacgccaccgucgccggcucccucucccucgccaucaugaucgccggcaucuccuucuggaugugcuccaacggcucccuccagugccgcaucugcaucuga

SEQ ID NO: 101214 - RNA, 1701 nt, Artificial Sequence
  derived and/or modified sequence opt2 from hemagglutinin__InfluenzaA__AFV68720
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccgacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101215 - RNA, 1701 nt, Artificial Sequence; identical to SEQ ID NO: 94181
  derived and/or modified sequence opt2 from hemagglutinin__InfluenzaA__AFX96347

SEQ ID NO: 101216 - RNA, 1701 nt, Artificial Sequence
  derived and/or modified sequence opt2 from hemagglutinin__InfluenzaA__AFX96359
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaagaucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucaacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101217 - RNA, 1701 nt, Artificial Sequence
  derived and/or modified sequence opt2 from hemagglutinin__InfluenzaA__AFX96366
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgaccgcggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccagcucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101218 - RNA, 1701 nt, Artificial Sequence; identical to SEQ ID NO: 95681
  derived and/or modified sequence opt2 from hemagglutinin__InfluenzaA__AFX96383

SEQ ID NO: 101219 - RNA, 1701 nt, Artificial Sequence; identical to SEQ ID NO: 94181
  derived and/or modified sequence opt2 from hemagglutinin__InfluenzaA__AFX96398

SEQ ID NO: 101220 - RNA, 1701 nt, Artificial Sequence; identical to SEQ ID NO: 94181
  derived and/or modified sequence opt2 from hemagglutinin__InfluenzaA__AFX96408

SEQ ID NO: 101221 - RNA, 1701 nt, Artificial Sequence; identical to SEQ ID NO: 94181
  derived and/or modified sequence opt2 from hemagglutinin__InfluenzaA__AFX96418

SEQ ID NO: 101222 - RNA, 1701 nt, Artificial Sequence; identical to SEQ ID NO: 94181
  derived and/or modified sequence opt2 from hemagglutinin__InfluenzaA__AFX96428

SEQ ID NO: 101223 - RNA, 1701 nt, Artificial Sequence; identical to SEQ ID NO: 94181
  derived and/or modified sequence opt2 from hemagglutinin__InfluenzaA__AFX96438

SEQ ID NO: 101224 - RNA, 1701 nt, Artificial Sequence; identical to SEQ ID NO: 94181
  derived and/or modified sequence opt2 from hemagglutinin__InfluenzaA__AFX96448

SEQ ID NO: 101225 - RNA, 1701 nt, Artificial Sequence; identical to SEQ ID NO: 94181
  derived and/or modified sequence opt2 from hemagglutinin__InfluenzaA__AFX96458

SEQ ID NO: 101226 - RNA, 1701 nt, Artificial Sequence; identical to SEQ ID NO: 94181
  derived and/or modified sequence opt2 from hemagglutinin__InfluenzaA__AFX96468

SEQ ID NO: 101227 - RNA, 1701 nt, Artificial Sequence; identical to SEQ ID NO: 94181
  derived and/or modified sequence opt2 from hemagglutinin__InfluenzaA__AFX96478

SEQ ID NO: 101228 - RNA, 1701 nt, Artificial Sequence; identical to SEQ ID NO: 94181
  derived and/or modified sequence opt2 from hemagglutinin__InfluenzaA__AFX96488

SEQ ID NO: 101229 - RNA, 1701 nt, Artificial Sequence
  derived and/or modified sequence opt2 from hemagglutinin__InfluenzaA__AFX96498
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagaucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101230 - RNA, 1701 nt, Artificial Sequence; identical to SEQ ID NO: 94181
  derived and/or modified sequence opt2 from hemagglutinin__InfluenzaA__AFX96508

SEQ ID NO: 101231 - RNA, 1701 nt, Artificial Sequence; identical to SEQ ID NO: 95681
  derived and/or modified sequence opt2 from hemagglutinin__InfluenzaA__AFX96518

SEQ ID NO: 101232 - RNA, 1701 nt, Artificial Sequence; identical to SEQ ID NO: 94181
  derived and/or modified sequence opt2 from hemagglutinin__InfluenzaA__AFX96528

SEQ ID NO: 101233 - RNA, 1701 nt, Artificial Sequence; identical to SEQ ID NO: 95681
  derived and/or modified sequence opt2 from hemagglutinin__InfluenzaA__AFX96538

SEQ ID NO: 101234 - RNA, 1701 nt, Artificial Sequence
  derived and/or modified sequence opt2 from hemagglutinin__InfluenzaA__AFX96548
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaagaucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101235 - RNA, 1701 nt, Artificial Sequence; identical to SEQ ID NO: 94181
  derived and/or modified sequence opt2 from hemagglutinin__InfluenzaA__AFX96558

SEQ ID NO: 101236 - RNA, 1701 nt, Artificial Sequence; identical to SEQ ID NO: 95341
  derived and/or modified sequence opt2 from hemagglutinin__InfluenzaA__AFX96568

SEQ ID NO: 101237 - RNA, 1701 nt, Artificial Sequence; identical to SEQ ID NO: 95341
  derived and/or modified sequence opt2 from hemagglutinin__InfluenzaA__AFX96578

SEQ ID NO: 101238 - RNA, 1701 nt, Artificial Sequence; identical to SEQ ID NO: 94181
  derived and/or modified sequence opt2 from hemagglutinin__InfluenzaA__AFX96588

SEQ ID NO: 101239 - RNA, 1701 nt, Artificial Sequence; identical to SEQ ID NO: 94181
  derived and/or modified sequence opt2 from hemagglutinin__InfluenzaA__AFX96598

SEQ ID NO: 101240 - RNA, 1701 nt, Artificial Sequence
  derived and/or modified sequence opt2 from hemagglutinin__InfluenzaA__AFX96608
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccacccucgccuccucccucguccucgucgucucccucggcgccaucuccuucuggaugugcuccaacggcucccuccagugccgcaucugcaucuga

SEQ ID NO: 101241 - RNA, 1701 nt, Artificial Sequence; identical to SEQ ID NO: 94181
  derived and/or modified sequence opt2 from hemagglutinin__InfluenzaA__AFX96618

SEQ ID NO: 101242 - RNA, 1701 nt, Artificial Sequence; identical to SEQ ID NO: 95341
  derived and/or modified sequence opt2 from hemagglutinin__InfluenzaA__AFX96628

SEQ ID NO: 101243 - RNA, 1701 nt, Artificial Sequence
  derived and/or modified sequence opt2 from hemagglutinin__InfluenzaA__AFX96638
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucgucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucauggucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101244 - RNA, 1701 nt, Artificial Sequence; identical to SEQ ID NO: 94181
  derived and/or modified sequence opt2 from hemagglutinin__InfluenzaA__AFX96648

SEQ ID NO: 101245 - RNA, 1701 nt, Artificial Sequence; identical to SEQ ID NO: 95341
  derived and/or modified sequence opt2 from hemagglutinin__InfluenzaA__AFX96658

SEQ ID NO: 101246 - RNA, 1701 nt, Artificial Sequence
  derived and/or modified sequence opt2 from hemagglutinin__InfluenzaA__AFX96668
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugcuccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101247 - RNA, 1701 nt, Artificial Sequence
  derived and/or modified sequence opt2 from hemagglutinin__InfluenzaA__AFX96678
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcucccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101248 - RNA, 1701 nt, Artificial Sequence
  derived and/or modified sequence opt2 from hemagglutinin__InfluenzaA__AFX96688
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgacugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagauguuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgacggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101249 - RNA, 1701 nt, Artificial Sequence; identical to SEQ ID NO: 94181
  derived and/or modified sequence opt2 from hemagglutinin__InfluenzaA__AFX96698

SEQ ID NO: 101250 - RNA, 1701 nt, Artificial Sequence
  derived and/or modified sequence opt2 from hemagglutinin__InfluenzaA__AFX96718
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagaucuccaaguccuacaucaacgacaagggcaaggagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaaggccaucgacgagaucaccaacaaggucaacuccgucaucgagaagaugaacacccaguucaccgccgucggcaaggaguucaaccaccucgagaagcgcaucgagaaccucaacaagaagaucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101251 - RNA, 1701 nt, Artificial Sequence; identical to SEQ ID NO: 101250
  derived and/or modified sequence opt2 from hemagglutinin__InfluenzaA__AFX96728

SEQ ID NO: 101252 - RNA, 1701 nt, Artificial Sequence; identical to SEQ ID NO: 94651
  derived and/or modified sequence opt2 from hemagglutinin__InfluenzaA__AFX96738

SEQ ID NO: 101253 - RNA, 1701 nt, Artificial Sequence
  derived and/or modified sequence opt2 from hemagglutinin__InfluenzaA__AFX96748
augaaggccauccucgucguccuccucuacaccaucgccaccgccaacgccgacacccucugcaucggcuaccacgccaacaacuccaccgacaccgucgacaccgucaucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagauguuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101254 - RNA, 1701 nt, Artificial Sequence
  derived and/or modified sequence opt2 from hemagglutinin__InfluenzaA__AFX96758
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagauguuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaagaucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101255 - RNA, 1701 nt, Artificial Sequence
  derived and/or modified sequence opt2 from hemagglutinin__InfluenzaA__AFX96768
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccaucuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccaccaagaucuaccagauccucgccaucuacuccaccgucgccuccucccucguccucgucgucucccucggcgccaucuccuucuggaugugcuccaacggcucccuccagugccgcaucugcaucuga

SEQ ID NO: 101256 - RNA, 1701 nt, Artificial Sequence
  derived and/or modified sequence opt2 from hemagglutinin__InfluenzaA__AFX96778
augaaggccauccucgucauccuccucuacaccuucgccaccgccaacgccgacacccucugcaucggcuaccacgccaacaacuccaccgacaccgucgacaccauccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101257 - RNA, 1701 nt, Artificial Sequence
  derived and/or modified sequence opt2 from hemagglutinin__InfluenzaA__AFX96788
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagaagaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101258 - RNA, 1701 nt, Artificial Sequence; identical to SEQ ID NO: 101257
  derived and/or modified sequence opt2 from hemagglutinin__InfluenzaA__AFX96798

SEQ ID NO: 101259 - RNA, 1701 nt, Artificial Sequence; identical to SEQ ID NO: 95341
  derived and/or modified sequence opt2 from hemagglutinin__InfluenzaA__AFX96808

SEQ ID NO: 101260 - RNA, 1701 nt, Artificial Sequence; identical to SEQ ID NO: 98421
  derived and/or modified sequence opt2 from hemagglutinin__InfluenzaA__AFX96818

SEQ ID NO: 101261 - RNA, 1701 nt, Artificial Sequence; identical to SEQ ID NO: 101257
  derived and/or modified sequence opt2 from hemagglutinin__InfluenzaA__AFX96828

SEQ ID NO: 101262 - RNA, 1701 nt, Artificial Sequence; identical to SEQ ID NO: 96778
  derived and/or modified sequence opt2 from hemagglutinin__InfluenzaA__AFX96838

SEQ ID NO: 101263 - RNA, 1701 nt, Artificial Sequence
  derived and/or modified sequence opt2 from hemagglutinin__InfluenzaA__AFX96856
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcacccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101264 - RNA, 1701 nt, Artificial Sequence; identical to SEQ ID NO: 101246
  derived and/or modified sequence opt2 from hemagglutinin__InfluenzaA__AFX96904

SEQ ID NO: 101265 - RNA, 1701 nt, Artificial Sequence; identical to SEQ ID NO: 95681
  derived and/or modified sequence opt2 from hemagglutinin__InfluenzaA__AFX96914

SEQ ID NO: 101266 - RNA, 1701 nt, Artificial Sequence
  derived and/or modified sequence opt2 from hemagglutinin__InfluenzaA__AFX96924
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagcgcuucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101267 - RNA, 1701 nt, Artificial Sequence; identical to SEQ ID NO: 94181
  derived and/or modified sequence opt2 from hemagglutinin__InfluenzaA__AFX96934

SEQ ID NO: 101268 - RNA, 1701 nt, Artificial Sequence
  derived and/or modified sequence opt2 from hemagglutinin__InfluenzaA__AFY24097
augaaggccauccucgucguccuccucuacaccuucgccaccgccaacgccgacacccucugcaucggcuaccacgccgacaacuccaccgacaccgucgacaccguccucgagaagaacgucaccgucacccacuccgucgaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucaacaaguccuacaucaacgacaagggcaaggagguccucguccucuggggcauccaccaccccuccaccuccaccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101269 - RNA, 1701 nt, Artificial Sequence; identical to SEQ ID NO: 92142
  derived and/or modified sequence opt2 from hemagglutinin__InfluenzaA__AFY24162

SEQ ID NO: 101270 - RNA, 1701 nt, Artificial Sequence
  derived and/or modified sequence opt2 from hemagglutinin__InfluenzaA__AFY24195
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101271 - RNA, 1701 nt, Artificial Sequence; identical to SEQ ID NO: 91697
  derived and/or modified sequence opt2 from hemagglutinin__InfluenzaA__AFY24217

SEQ ID NO: 101272 - RNA, 1701 nt, Artificial Sequence
  derived and/or modified sequence opt2 from hemagglutinin__InfluenzaA__AGB08294
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccaggccggcgccaaguccuucuacaagaaccucaucuggcucgucaagaagggcaacuccuaccccaagcucaucaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccguccgccccaagguccgcgaccaggagggccgcaugaacuacuacuggacccucgucgagcccggcgacaagaucaccuucgaggccaccggcaaccuccucgucccccgcuacgccuucgucauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgcccagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuacccccgcuacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101273 - RNA, 1701 nt, Artificial Sequence
  derived and/or modified sequence opt2 from hemagglutinin__InfluenzaA__AGB08295
augaaggccauccucgucguccuccucuacaccuucgccaccgccaacgccgacacccucugcaucggcuaccacgccaacaacuccaccgacaccgucgacaccgucaucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagcgcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaccgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101274 - RNA, 1701 nt, Artificial Sequence
  derived and/or modified sequence opt2 from hemagglutinin__InfluenzaA__AGB08296
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcggccaggagggccgcaugaacuacuacuggacccucgucgagcccggcgacaagaucaccuucgaggccaccggcaaccucgucgucccccgcuacgccuucgccauggagcgcaccgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101275 - RNA, 1701 nt, Artificial Sequence
  derived and/or modified sequence opt2 from hemagglutinin__InfluenzaA__AGB08297
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccgaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaccgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101276 - RNA, 1701 nt, Artificial Sequence
  derived and/or modified sequence opt2 from hemagglutinin__InfluenzaA__AGB08298
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcaucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuacccccgccucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaccgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccagcucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101277 - RNA, 1701 nt, Artificial Sequence
  derived and/or modified sequence opt2 from hemagglutinin__InfluenzaA__AGB08301
augaagaccaucaucgcccucuccuacauccucugccucgucuucgcccaggagcuccccggcaacgacgacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccgucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101278 - RNA, 1701 nt, Artificial Sequence
  derived and/or modified sequence opt2 from hemagglutinin__InfluenzaA__AGB08343
augaagaccaucaucgcccucuccuacaucuucugccucguccucgcccaggaccuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcaacaacccccaccgcauccucgacggcaucaacugcacccucaucgacgcccuccucggcgacccccacugcgacggcuuccagaacaagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccagaacggcggcuccuacgccugcaagcgcggccccgacaacggcuucuucucccgccucaacuggcucuacaaguccgaguccaccuaccccguccucaacgucaccaugcccaacaacgacaacuucgacaagcucuacaucuggggcguccaccaccccuccaccgacaaggagcagaccaaccucuacguccaggccuccggccgcgucaccgucuccaccaagcgcucccagcagaccaucauccccaacgucggcucccgccccuggguccgcggccucuccucccgcaucuccaucuacuggaccaucgucaagcccggcgacauccucgucaucaacuccaacggcaaccucaucgccccccgcggcuacuucaagauccgcaacggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 101279 - RNA, 1701 nt, Artificial Sequence
  derived and/or modified sequence opt2 from hemagglutinin__InfluenzaA__AGB08362
augaagaccaucaucgcccucuccuacaucuucugccucgcccucggccaggaccuccccggcaacgacaacuccaccgccacccucugccucggccaccacgccguccccaacggcacccucgucaagaccaucaccgacgaccagaucgaggucaccaacgccaccgagcucguccaguccuccuccaccggcaagaucugcaacaacccccaccgcauccucgacggcaucaacugcacccucaucgacgcccuccucggcgacccccacugcgacgucuuccaggacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucggcucccgccccuggguccgcggccucuccucccgcaucuccaucuacuggaccaucgucaagcccggcgacguccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgacaagacccgccgccagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 101280 - RNA, 1701 nt, Artificial Sequence; identical to SEQ ID NO: 98334
  derived and/or modified sequence opt2 from hemagglutinin__InfluenzaA__AGB12986

SEQ ID NO: 101281 - RNA, 1701 nt, Artificial Sequence; identical to SEQ ID NO: 98598
  derived and/or modified sequence opt2 from hemagglutinin__InfluenzaA__AGB13006

SEQ ID NO: 101282 - RNA, 1701 nt, Artificial Sequence
  derived and/or modified sequence opt2 from hemagglutinin__InfluenzaA__AGB13016
augaaggccauccucgucguccuccucuacaccaucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaucggcaaccucgucgucccccgcuacgccuucgccauggagaagaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccgcccgcgucuaccagauccucgccaucuacuccaccgucgccuccucccucguccucgucgucucccucggcgccaucuccuucuggaugugcuccaacggcucccuccagugccgcaucugcaucuga

SEQ ID NO: 101283 - RNA, 1701 nt, Artificial Sequence; identical to SEQ ID NO: 98379
  derived and/or modified sequence opt2 from hemagglutinin__InfluenzaA__AGB13026

SEQ ID NO: 101284 - RNA, 1701 nt, Artificial Sequence; identical to SEQ ID NO: 98321
  derived and/or modified sequence opt2 from hemagglutinin__InfluenzaA__AGB13036

SEQ ID NO: 101285 - RNA, 1701 nt, Artificial Sequence
  derived and/or modified sequence opt2 from hemagglutinin__InfluenzaA__AGB13048
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcaucgaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101286 - RNA, 1701 nt, Artificial Sequence
  derived and/or modified sequence opt2 from hemagglutinin__InfluenzaA__AGB13066
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaagggcaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101287 - RNA, 1701 nt, Artificial Sequence; identical to SEQ ID NO: 98421
  derived and/or modified sequence opt2 from hemagglutinin__InfluenzaA__AGB13082

SEQ ID NO: 101288 - RNA, 1701 nt, Artificial Sequence; identical to SEQ ID NO: 98321
  derived and/or modified sequence opt2 from hemagglutinin__InfluenzaA__AGB13105

SEQ ID NO: 101289 - RNA, 1701 nt, Artificial Sequence; identical to SEQ ID NO: 98379
  derived and/or modified sequence opt2 from hemagglutinin__InfluenzaA__AGB13125

SEQ ID NO: 101290 - RNA, 1701 nt, Artificial Sequence; identical to SEQ ID NO: 98379
  derived and/or modified sequence opt2 from hemagglutinin__InfluenzaA__AGB13130

SEQ ID NO: 101291 - RNA, 1701 nt, Artificial Sequence
  derived and/or modified sequence opt2 from hemagglutinin__InfluenzaA__AGB13140
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccucccucugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101292 - RNA, 1701 nt, Artificial Sequence
  derived and/or modified sequence opt2 from hemagglutinin__InfluenzaA__AGB13159
augaaggccauccucgucgucaugcucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccucccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101293 - RNA, 1701 nt, Artificial Sequence; identical to SEQ ID NO: 98336
  derived and/or modified sequence opt2 from hemagglutinin__InfluenzaA__AGB13170

SEQ ID NO: 101294 - RNA, 1701 nt, Artificial Sequence
  derived and/or modified sequence opt2 from hemagglutinin__InfluenzaA__AGB13180
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacaccuccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101295 - RNA, 1701 nt, Artificial Sequence; identical to SEQ ID NO: 98379
  derived and/or modified sequence opt2 from hemagglutinin__InfluenzaA__AGB13190

SEQ ID NO: 101296 - RNA, 1701 nt, Artificial Sequence
  derived and/or modified sequence opt2 from hemagglutinin__InfluenzaA__AGB13200
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgucaaguccuucuacaagaaccucaucuggcucgucaagaagggcaacuccuaccccaagcucuccaaguccuacaucaacgacaagggcaaggagguccucguccucuggggcauccaccaccccuccaccaccaccgaccagcagucccucuaccagaacgccgacgccuacgucuucgucggcaccuccaaguacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101297 - RNA, 1701 nt, Artificial Sequence
  derived and/or modified sequence opt2 from hemagglutinin__InfluenzaA__AGB13210
augaaggccacccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccguccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101298 - RNA, 1701 nt, Artificial Sequence
  derived and/or modified sequence opt2 from hemagglutinin__InfluenzaA__AGB13220
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaucuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccuccaaguacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101299 - RNA, 1701 nt, Artificial Sequence
  derived and/or modified sequence opt2 from hemagglutinin__InfluenzaA__AGB13230
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaaccacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccgccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101300 - RNA, 1701 nt, Artificial Sequence; identical to SEQ ID NO: 98379
  derived and/or modified sequence opt2 from hemagglutinin__InfluenzaA__AGB13240

SEQ ID NO: 101301 - RNA, 1701 nt, Artificial Sequence; identical to SEQ ID NO: 98379
  derived and/or modified sequence opt2 from hemagglutinin__InfluenzaA__AGB13250

SEQ ID NO: 101302 - RNA, 1701 nt, Artificial Sequence
  derived and/or modified sequence opt2 from hemagglutinin__InfluenzaA__AGB13260
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccaccgccugcccccacgccggcuccaaguccuucuacaagaaccucaucuggcucgucaagaagggcaacuccuaccccaagcucuccaaguccuacaucaacgacaagggcaaggagguccucguccucuggggcauccaccacccccccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacguccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccaucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101303 - RNA, 1701 nt, Artificial Sequence
  derived and/or modified sequence opt2 from hemagglutinin__InfluenzaA__AGB13270
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccguccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101304 - RNA, 1701 nt, Artificial Sequence
  derived and/or modified sequence opt2 from hemagglutinin__InfluenzaA__AGB13280
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaacgccgaccagcagucccucuaccagaacgccgacgccuacgucuucgucggcaccuccaaguacuccaagaaguucaagcccgagaucgccguccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacggccagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101305 - RNA, 1701 nt, Artificial Sequence
  derived and/or modified sequence opt2 from hemagglutinin__InfluenzaA__AGB13290
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggucaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101306 - RNA, 1701 nt, Artificial Sequence; identical to SEQ ID NO: 98379
  derived and/or modified sequence opt2 from hemagglutinin__InfluenzaA__AGB13300

SEQ ID NO: 101307 - RNA, 1701 nt, Artificial Sequence
  derived and/or modified sequence opt2 from hemagglutinin__InfluenzaA__AGB13310
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcguccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagcacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101308 - RNA, 1701 nt, Artificial Sequence
  derived and/or modified sequence opt2 from hemagglutinin__InfluenzaA__AGB13320
augaaggccauccucgucguccuccucuacaccaucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagaagaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccgcccgcgucuaccagauccucgccaucuacuccaccgucgccuccucccucguccucgucgucucccucggcgccaucuccuucuggaugugcuccaacggcucccuccagugccgcaucugcaucuga

SEQ ID NO: 101309 - RNA, 1701 nt, Artificial Sequence
  derived and/or modified sequence opt2 from hemagglutinin__InfluenzaA__AGB13330
augaaggccauccucgucgucaugcucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacuccaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101310 - RNA, 1701 nt, Artificial Sequence; identical to SEQ ID NO: 98379
  derived and/or modified sequence opt2 from hemagglutinin__InfluenzaA__AGB13340

SEQ ID NO: 101311 - RNA, 1701 nt, Artificial Sequence
  derived and/or modified sequence opt2 from hemagglutinin__InfluenzaA__AGB13350
augaaggccauccucgucguccuccucuacaccuucgccaccgccaacgccgacacccucugcaucggcuaccacgccaacaacuccaccgagaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccaggccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccguccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgcccagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101312 - RNA, 1701 nt, Artificial Sequence
  derived and/or modified sequence opt2 from hemagglutinin__InfluenzaA__AGB13360
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccguccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagaugcucguccuccucgagaacgagaagacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101313 - RNA, 1701 nt, Artificial Sequence
  derived and/or modified sequence opt2 from hemagglutinin__InfluenzaA__AGB13380
augaaggccauccucgucguccuccucuacaccuucgccaccgccaaggccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaaccccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101314 - RNA, 1701 nt, Artificial Sequence; identical to SEQ ID NO: 97947
  derived and/or modified sequence opt2 from hemagglutinin__InfluenzaA__AGB13390

SEQ ID NO: 101315 - RNA, 1701 nt, Artificial Sequence; identical to SEQ ID NO: 98554
  derived and/or modified sequence opt2 from hemagglutinin__InfluenzaA__AGB13400

SEQ ID NO: 101316 - RNA, 1701 nt, Artificial Sequence; identical to SEQ ID NO: 97947
  derived and/or modified sequence opt2 from hemagglutinin__InfluenzaA__AGB13410

SEQ ID NO: 101317 - RNA, 1701 nt, Artificial Sequence; identical to SEQ ID NO: 97966
  derived and/or modified sequence opt2 from hemagglutinin__InfluenzaA__AGB13420

SEQ ID NO: 101318 - RNA, 1701 nt, Artificial Sequence
  derived and/or modified sequence opt2 from hemagglutinin__InfluenzaA__AGB13430
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagauguuccccaagaccuccuccuggcccaaccacgacuccaacaagggcgucaccaccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccacccccccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacggcaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccaccaugaucuaccagauccucgccaucuacuccaccgucgccuccucccucguccucgucgucucccucggcgccaucuccuucuggaugugcuccaacggcucccuccagugccgcaucugcaucuga

SEQ ID NO: 101319 - RNA, 1701 nt, Artificial Sequence; identical to SEQ ID NO: 98554
  derived and/or modified sequence opt2 from hemagglutinin__InfluenzaA__AGB13440

SEQ ID NO: 101320 - RNA, 1701 nt, Artificial Sequence; identical to SEQ ID NO: 97966
  derived and/or modified sequence opt2 from hemagglutinin__InfluenzaA__AGB13450

SEQ ID NO: 101321 - RNA, 1701 nt, Artificial Sequence; identical to SEQ ID NO: 97947
  derived and/or modified sequence opt2 from hemagglutinin__InfluenzaA__AGB13460

SEQ ID NO: 101322 - RNA, 1701 nt, Artificial Sequence; identical to SEQ ID NO: 98379
  derived and/or modified sequence opt2 from hemagglutinin__InfluenzaA__AGB13470

SEQ ID NO: 101323 - RNA, 1701 nt, Artificial Sequence; identical to SEQ ID NO: 97966
  derived and/or modified sequence opt2 from hemagglutinin__InfluenzaA__AGB13480

SEQ ID NO: 101324 - RNA, 1701 nt, Artificial Sequence; identical to SEQ ID NO: 98379
  derived and/or modified sequence opt2 from hemagglutinin__InfluenzaA__AGB13490

SEQ ID NO: 101325 - RNA, 1701 nt, Artificial Sequence
  derived and/or modified sequence opt2 from hemagglutinin__InfluenzaA__AGB13500
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcaacuucaucgacuacgaggagcuccgcgagcagcucuccuccgucuccuccuucgagcgcuucgagaucuuccccaagaccuccuccuggcccgaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgccccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101326 - RNA, 1701 nt, Artificial Sequence; identical to SEQ ID NO: 98584
  derived and/or modified sequence opt2 from hemagglutinin__InfluenzaA__AGB13520

SEQ ID NO: 101327 - RNA, 1701 nt, Artificial Sequence
  derived and/or modified sequence opt2 from hemagglutinin__InfluenzaA__AGB13530
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucaacaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucaacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101328 - RNA, 1701 nt, Artificial Sequence; identical to SEQ ID NO: 98598
  derived and/or modified sequence opt2 from hemagglutinin__InfluenzaA__AGB13540

SEQ ID NO: 101329 - RNA, 1701 nt, Artificial Sequence; identical to SEQ ID NO: 98562
  derived and/or modified sequence opt2 from hemagglutinin__InfluenzaA__AGB13550

SEQ ID NO: 101330 - RNA, 1701 nt, Artificial Sequence; identical to SEQ ID NO: 98562
  derived and/or modified sequence opt2 from hemagglutinin__InfluenzaA__AGB13560

SEQ ID NO: 101331 - RNA, 1701 nt, Artificial Sequence; identical to SEQ ID NO: 98379
  derived and/or modified sequence opt2 from hemagglutinin__InfluenzaA__AGB13570

SEQ ID NO: 101332 - RNA, 1701 nt, Artificial Sequence
  derived and/or modified sequence opt2 from hemagglutinin__InfluenzaA__AGB13580
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcaacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101333 - RNA, 1701 nt, Artificial Sequence
  derived and/or modified sequence opt2 from hemagglutinin__InfluenzaA__AGB13590
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101334 - RNA, 1701 nt, Artificial Sequence
  derived and/or modified sequence opt2 from hemagglutinin__InfluenzaA__AGB13600
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucaacaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101335 - RNA, 1701 nt, Artificial Sequence; identical to SEQ ID NO: 98379
  derived and/or modified sequence opt2 from hemagglutinin__InfluenzaA__AGB13610

SEQ ID NO: 101336 - RNA, 1701 nt, Artificial Sequence; identical to SEQ ID NO: 98598
  derived and/or modified sequence opt2 from hemagglutinin__InfluenzaA__AGB13620

SEQ ID NO: 101337 - RNA, 1701 nt, Artificial Sequence; identical to SEQ ID NO: 97966
  derived and/or modified sequence opt2 from hemagglutinin__InfluenzaA__AGB13630

SEQ ID NO: 101338 - RNA, 1701 nt, Artificial Sequence
  derived and/or modified sequence opt2 from hemagglutinin__InfluenzaA__AGB13640
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccaccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccacccccccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacggcaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccaccaugaucuaccagauccucgccaucuacuccaccgucgccuccucccucguccucaucgucucccucggcgccaucuccuucuggaugugcuccaacggcucccuccagugccgcaucugcaucuga

SEQ ID NO: 101339 - RNA, 1701 nt, Artificial Sequence
  derived and/or modified sequence opt2 from hemagglutinin__InfluenzaA__AGB13650
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccaccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccacccccccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacggcaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucauccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccaccaugaucuaccagauccucgccaucuacuccaccgucgccuccucccucguccucaucgucucccucggcgccaucuccuucuggaugugcuccaacggcucccuccagugccgcaucugcaucuga

SEQ ID NO: 101340 - RNA, 1701 nt, Artificial Sequence; identical to SEQ ID NO: 98336
  derived and/or modified sequence opt2 from hemagglutinin__InfluenzaA__AGB13660

SEQ ID NO: 101341 - RNA, 1701 nt, Artificial Sequence; identical to SEQ ID NO: 97947
  derived and/or modified sequence opt2 from hemagglutinin__InfluenzaA__AGB13721

SEQ ID NO: 101342 - RNA, 1701 nt, Artificial Sequence; identical to SEQ ID NO: 98379
  derived and/or modified sequence opt2 from hemagglutinin__InfluenzaA__AGB13731

SEQ ID NO: 101343 - RNA, 1701 nt, Artificial Sequence
  derived and/or modified sequence opt2 from hemagglutinin__InfluenzaA__AGB51356
augaaggccauccuccucguccuccucugcaccuucgccgccaccaacgccgacacccucugcaucggcuaccacgccaacaacuccaccgacaccgucgacaccguccucgagaagaacgucaccgucacccacuccgucaaccuccucgaggaccgccacaacggcaagcucugcaagcucggcggcaucgccccccuccaccucggcaagugcaacaucgccggcuggcuccucggcaaccccgagugcgagcuccuccucaccgucuccuccugguccuacaucgucgagaccuccaacuccgacaacggcaccugcuaccccggcgacuucaucaacuacgaggagcuccgcgagcagcucuccuccgucuccuccuucgagcgcuucgagaucuuccccaagaccuccuccuggcccaaccacgagaccaaccgcggcgucaccgccgccugccccuacgccggcgccaacuccuucuaccgcaaccucaucuggcucgucgagaagggcaacuccuaccccaagcucuccaaguccuacgucaacaacaagggcaaggagguccucguccucuggggcauccaccacccccccaccuccaccgaccagcagucccucuaccagaacgccgacgccuacgucuucgucggcuccuccaaguacaaccgcaaguucaagcccgagaucgccgcccgccccaagguccgcggccaggccggccgcaugaacuacuacuggacccucaucgagcccggcgacaccaucaccuucgaggccaccggcaaccucgucgucccccgcuacgccuucgccaugaaccgcggcuccggcuccggcaucaucaucuccgacgcccccguccacgacugcaacaccaagugccagacccccaagggcgccaucaacaccucccuccccuuccagaacauccaccccgucaccaucggcgagugccccaaguacgucaaguccaccaagcuccgcauggccaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagcgcuccacccagaacgccaucgacggcaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuuccacgacuccaacgucaagaaccucuacgagaagguccgcucccagcuccgcaacaacgccaaggagaucggcaacggcugcuucgaguucuaccacaagugcgacgacaccugcauggaguccgucaagaacggcaccuacgacuaccccaaguacuccgaggaguccaagcucaaccgcgaggagaucgacggcgucaagcucgaguccacccgcaucuaccagauccucgccaucuacuccaccgucgccuccucccucguccuccucgucucccucggcgccaucuccuucuggaugugcuccaacggcucccuccagugccgcaucugcaucuga

SEQ ID NO: 101344 - RNA, 1701 nt, Artificial Sequence
  derived and/or modified sequence opt2 from hemagglutinin__InfluenzaA__AGB97269
augaaggccauccucgucguccuccucuacaccuucgccaccgccaacgccgacacccucugcaucggcuaccacgccaacaacuccaccgacaccgucgacaccguccucgagaagaacaucaccgucacccacuccgucaaccuccucgaggacaagcacaacggcaagcucugcaagcuccgcggcgucgccccccuccaccucggcaagugcaacaucgccggcuggauccucggcaaccccgagugcgagacccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcgacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 101345 - RNA, 1701 nt, Artificial Sequence; identical to SEQ ID NO: 99698
  derived and/or modified sequence opt2 from hemagglutinin__InfluenzaA__AGB97273

SEQ ID NO: 101346 - RNA, 1701 nt, Artificial Sequence
  derived and/or modified sequence opt2 from hemagglutinin__InfluenzaA__AGB97288
augaagaccaucaucgcccucggcuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcaagaacugcacccucaucgacgcccuccucggcgacccccagugcgacggcuuccagaacaagaagugggaccucuucaucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgccaaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101347 - RNA, 1701 nt, Artificial Sequence
  derived and/or modified sequence opt2 from hemagglutinin__InfluenzaA__AGB97292
augaagaccaucaucgcccucuccuacauccucugccucgucuucgcccaggagcuccccggcaacgacgacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101348 - RNA, 1701 nt, Artificial Sequence
  derived and/or modified sequence opt2 from hemagglutinin__InfluenzaA__AGB97300
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101349 - RNA, 1701 nt, Artificial Sequence
  derived and/or modified sequence opt2 from hemagglutinin__InfluenzaA__AGE89267
augaaggccauccucaucguccuccucuacaccuucgccaccgccaacgccgacacccucugcaucggcuaccacgccaacaacuccaccgacaccgucgacaccguccucgagaagaacgucaccgucacccacuccgucgaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgagaaguccuucuacaagaaccucaucuggcucgucaagaagggcaacuccuaccccaagcucaacaaguccuacaucaacgacaagggcaaggagguccucguccucuggggcauccaccaccccuccaccuccaccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccauccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaaggucaagucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101350 - RNA, 1701 nt, Artificial Sequence
  derived and/or modified sequence opt2 from hemagglutinin__InfluenzaA__AGE89277
augaaggccauccucaucguccuccucuacaccuucgccaccgccaacgccgacacccucugcaucggcuaccacgccaacaacuccaccgacaccgucgacaccguccucgagaagaacgucaccgucacccacuccgucgaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucaacuccgucuccuccuucgagcgcuucgagaucuuccccaagaccuccuccuggcccaaccacgacuccaacaagggcgucaccgccgccugcccccacgccggcgagaaguccuucuacaagaaccucaucuggcucgucaagaagggcaacuccuaccccaagcucaacaaguccuacaucaacgacaagggcaaggagguccucguccucuggggcauccaccaccccuccaccuccaccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccauccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaaggucaagucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101351 - RNA, 1701 nt, Artificial Sequence; identical to SEQ ID NO: 99868
  derived and/or modified sequence opt2 from hemagglutinin__InfluenzaA__AGE89287

SEQ ID NO: 101352 - RNA, 1701 nt, Artificial Sequence
  derived and/or modified sequence opt2 from hemagglutinin__InfluenzaA__AGE89298
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucauccucgucgucucccucggcgccaucuccuucuggaugugcuccaacggcucccuccagugccgcaucugcaucuga

SEQ ID NO: 101353 - RNA, 1701 nt, Artificial Sequence; identical to SEQ ID NO: 98421
  derived and/or modified sequence opt2 from hemagglutinin__InfluenzaA__AGE89308

SEQ ID NO: 101354 - RNA, 1701 nt, Artificial Sequence; identical to SEQ ID NO: 99863
  derived and/or modified sequence opt2 from hemagglutinin__InfluenzaA__AGE89318

SEQ ID NO: 101355 - RNA, 1701 nt, Artificial Sequence
  derived and/or modified sequence opt2 from hemagglutinin__InfluenzaA__AGE89329
augaagaccaucaucgcccucuccuacauccucugccucgucuucgcccagaagcuccccggcaacgacgacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101356 - RNA, 1701 nt, Artificial Sequence; identical to SEQ ID NO: 97966
  derived and/or modified sequence opt2 from hemagglutinin__InfluenzaA__AGE89340

SEQ ID NO: 101357 - RNA, 1701 nt, Artificial Sequence; identical to SEQ ID NO: 99866
  derived and/or modified sequence opt2 from hemagglutinin__InfluenzaA__AGE89350

SEQ ID NO: 101358 - RNA, 1701 nt, Artificial Sequence
  derived and/or modified sequence opt2 from hemagglutinin__InfluenzaA__AGE89361
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccaccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101359 - RNA, 1701 nt, Artificial Sequence; identical to SEQ ID NO: 99863
  derived and/or modified sequence opt2 from hemagglutinin__InfluenzaA__AGE89371

SEQ ID NO: 101360 - RNA, 1701 nt, Artificial Sequence
  derived and/or modified sequence opt2 from hemagglutinin__InfluenzaA__AGE89382
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccguccgccccaagguccgcgaccaggagggccgcaugaacuacuacuggacccucgucaagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101361 - RNA, 1701 nt, Artificial Sequence
  derived and/or modified sequence opt2 from hemagglutinin__InfluenzaA__AGE89392
augaagaccaucaucgcccucuccuacauccucugccucgucuucgcccaggagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101362 - RNA, 1701 nt, Artificial Sequence; identical to SEQ ID NO: 101349
  derived and/or modified sequence opt2 from hemagglutinin__InfluenzaA__AGE89422

SEQ ID NO: 101363 - RNA, 1701 nt, Artificial Sequence; identical to SEQ ID NO: 99846
  derived and/or modified sequence opt2 from hemagglutinin__InfluenzaA__AGE89719

SEQ ID NO: 101364 - RNA, 1701 nt, Artificial Sequence
  derived and/or modified sequence opt2 from hemagglutinin__InfluenzaA__AGE89730
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccguccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacggccagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101365 - RNA, 1701 nt, Artificial Sequence; identical to SEQ ID NO: 99863
  derived and/or modified sequence opt2 from hemagglutinin__InfluenzaA__AGE89740

SEQ ID NO: 101366 - RNA, 1701 nt, Artificial Sequence
  derived and/or modified sequence opt2 from hemagglutinin__InfluenzaA__AGE89751
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccgccggcgagaucugcgacuccccccaccacauccucgacggcgagaacugcacccucaucgacgcccuccucggcgacccccagugcgacggcuuccagaacaagaagugggaccucuucgucgagcgcucccgcgccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgccauggagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucuccaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101367 - RNA, 1701 nt, Artificial Sequence; identical to SEQ ID NO: 99866
  derived and/or modified sequence opt2 from hemagglutinin__InfluenzaA__AGE89762

SEQ ID NO: 101368 - RNA, 1701 nt, Artificial Sequence
  derived and/or modified sequence opt2 from hemagglutinin__InfluenzaA__AGF44891
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucaucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccgucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101369 - RNA, 1701 nt, Artificial Sequence; identical to SEQ ID NO: 101368
  derived and/or modified sequence opt2 from hemagglutinin__InfluenzaA__AGF44892

SEQ ID NO: 101370 - RNA, 1701 nt, Artificial Sequence
  derived and/or modified sequence opt2 from hemagglutinin__InfluenzaA__AGF44895
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101371 - RNA, 1701 nt, Artificial Sequence; identical to SEQ ID NO: 101347
  derived and/or modified sequence opt2 from hemagglutinin__InfluenzaA__AGF44896

SEQ ID NO: 101372 - RNA, 1701 nt, Artificial Sequence
  derived and/or modified sequence opt2 from hemagglutinin__InfluenzaA__AGF44897
augaagaccaucaucgcccucuccuacauccucugccucgucuucgcccaggagcuccccggcaacgacgacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcaugcgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101373 - RNA, 1701 nt, Artificial Sequence; identical to SEQ ID NO: 101370
  derived and/or modified sequence opt2 from hemagglutinin__InfluenzaA__AGF44900

SEQ ID NO: 101374 - RNA, 1701 nt, Artificial Sequence; identical to SEQ ID NO: 101370
  derived and/or modified sequence opt2 from hemagglutinin__InfluenzaA__AGF44901

SEQ ID NO: 101375 - RNA, 1701 nt, Artificial Sequence; identical to SEQ ID NO: 101370
  derived and/or modified sequence opt2 from hemagglutinin__InfluenzaA__AGF44902

SEQ ID NO: 101376 - RNA, 1701 nt, Artificial Sequence; identical to SEQ ID NO: 101370
  derived and/or modified sequence opt2 from hemagglutinin__InfluenzaA__AGF44903

SEQ ID NO: 101377 - RNA, 1701 nt, Artificial Sequence; identical to SEQ ID NO: 101370
  derived and/or modified sequence opt2 from hemagglutinin__InfluenzaA__AGF44904

SEQ ID NO: 101378 - RNA, 1701 nt, Artificial Sequence
  derived and/or modified sequence opt2 from hemagglutinin__InfluenzaA__AGF44905
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaacaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101379 - RNA, 1701 nt, Artificial Sequence; identical to SEQ ID NO: 101370
  derived and/or modified sequence opt2 from hemagglutinin__InfluenzaA__AGF44906

SEQ ID NO: 101380 - RNA, 1701 nt, Artificial Sequence
  derived and/or modified sequence opt2 from hemagglutinin__InfluenzaA__AGF44908
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101381 - RNA, 1701 nt, Artificial Sequence; identical to SEQ ID NO: 101370
  derived and/or modified sequence opt2 from hemagglutinin__InfluenzaA__AGF44909

SEQ ID NO: 101382 - RNA, 1701 nt, Artificial Sequence; identical to SEQ ID NO: 101370
  derived and/or modified sequence opt2 from hemagglutinin__InfluenzaA__AGF44910

SEQ ID NO: 101383 - RNA, 1701 nt, Artificial Sequence
  derived and/or modified sequence opt2 from hemagglutinin__InfluenzaA__AGF44911
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaccuccugcuuccuccucugcgucgcccuccucggcuucaucaugugggccugccagaagggcaacauccgcugcaacaucugcaucuga

SEQ ID NO: 101384 - RNA, 1701 nt, Artificial Sequence; identical to SEQ ID NO: 101370
  derived and/or modified sequence opt2 from hemagglutinin__InfluenzaA__AGF44912

SEQ ID NO: 101385 - RNA, 1701 nt, Artificial Sequence; identical to SEQ ID NO: 101370
  derived and/or modified sequence opt2 from hemagglutinin__InfluenzaA__AGF44913

SEQ ID NO: 101386 - RNA, 1701 nt, Artificial Sequence
  derived and/or modified sequence opt2 from hemagglutinin__InfluenzaA__AGF44914
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaacaagaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101387 - RNA, 1701 nt, Artificial Sequence; identical to SEQ ID NO: 101347
  derived and/or modified sequence opt2 from hemagglutinin__InfluenzaA__AGF44916

SEQ ID NO: 101388 - RNA, 1701 nt, Artificial Sequence
  derived and/or modified sequence opt2 from hemagglutinin__InfluenzaA__AGF44917
augaagaccaucaucgcccucuccuacauccucugccucgucuucgcccagaagauccccggcaacgacaacuccaccgccacccucugccucggccaccacgccguccccaacggcaccaucgucaagaccaucaccaacgagcagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcggcuccgacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101389 - RNA, 1701 nt, Artificial Sequence; identical to SEQ ID NO: 101347
  derived and/or modified sequence opt2 from hemagglutinin__InfluenzaA__AGF44918

SEQ ID NO: 101390 - RNA, 1701 nt, Artificial Sequence
  derived and/or modified sequence opt2 from hemagglutinin__InfluenzaA__AGF44919
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacuacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101391 - RNA, 1701 nt, Artificial Sequence; identical to SEQ ID NO: 101347
  derived and/or modified sequence opt2 from hemagglutinin__InfluenzaA__AGF44920

SEQ ID NO: 101392 - RNA, 1701 nt, Artificial Sequence; identical to SEQ ID NO: 101370
  derived and/or modified sequence opt2 from hemagglutinin__InfluenzaA__AGF44921

SEQ ID NO: 101393 - RNA, 1701 nt, Artificial Sequence
  derived and/or modified sequence opt2 from hemagglutinin__InfluenzaA__AGG13411
augaagaccaucaucgcccucuccuacauccucugccucgucuucgcccaggagcuccccggcaacgacgacuccaccgccacccucugccucggccaccacgccguccccaacggcaccaucgucaagaccaucaccaacgaccgcaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcaaccagcagaccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101394 - RNA, 1701 nt, Artificial Sequence
  derived and/or modified sequence opt2 from hemagglutinin__InfluenzaA__AGG13447
augaagaccaucaucgcccucuccuacauccucugccucgucuucgcccaggagcuccccggcaacgacgacuccaccgccacccucugccucggccaccacgccguccccaacggcaccaucgucaagaccaucaccaacgaccgcaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101395 - RNA, 1701 nt, Artificial Sequence
  derived and/or modified sequence opt2 from hemagglutinin__InfluenzaA__AGG13459
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101396 - RNA, 1701 nt, Artificial Sequence
  derived and/or modified sequence opt2 from hemagglutinin__InfluenzaA__AGG13495
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccgacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaguccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101397 - RNA, 1701 nt, Artificial Sequence; identical to SEQ ID NO: 101395
  derived and/or modified sequence opt2 from hemagglutinin__InfluenzaA__AGG13507

SEQ ID NO: 101398 - RNA, 1701 nt, Artificial Sequence
  derived and/or modified sequence opt2 from hemagglutinin__InfluenzaA__AGG13519
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccgacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaguccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcguccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101399 - RNA, 1701 nt, Artificial Sequence; identical to SEQ ID NO: 101395
  derived and/or modified sequence opt2 from hemagglutinin__InfluenzaA__AGG13531

SEQ ID NO: 101400 - RNA, 1701 nt, Artificial Sequence
  derived and/or modified sequence opt2 from hemagglutinin__InfluenzaA__AGG13543
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggacaucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101401 - RNA, 1701 nt, Artificial Sequence; identical to SEQ ID NO: 101395
  derived and/or modified sequence opt2 from hemagglutinin__InfluenzaA__AGG13555

SEQ ID NO: 101402 - RNA, 1701 nt, Artificial Sequence; identical to SEQ ID NO: 101395
  derived and/or modified sequence opt2 from hemagglutinin__InfluenzaA__AGG13567

SEQ ID NO: 101403 - RNA, 1701 nt, Artificial Sequence
  derived and/or modified sequence opt2 from hemagglutinin__InfluenzaA__AGG13591
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgagaacuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgaccgccccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101404 - RNA, 1701 nt, Artificial Sequence
  derived and/or modified sequence opt2 from hemagglutinin__InfluenzaA__AGG13615
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccuccgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101405 - RNA, 1701 nt, Artificial Sequence; identical to SEQ ID NO: 101403
  derived and/or modified sequence opt2 from hemagglutinin__InfluenzaA__AGG13627

SEQ ID NO: 101406 - RNA, 1701 nt, Artificial Sequence
  derived and/or modified sequence opt2 from hemagglutinin__InfluenzaA__AGG13639
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccaacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101407 - RNA, 1701 nt, Artificial Sequence; identical to SEQ ID NO: 101396
  derived and/or modified sequence opt2 from hemagglutinin__InfluenzaA__AGG13651

SEQ ID NO: 101408 - RNA, 1701 nt, Artificial Sequence; identical to SEQ ID NO: 101395
  derived and/or modified sequence opt2 from hemagglutinin__InfluenzaA__AGG13663

SEQ ID NO: 101409 - RNA, 1701 nt, Artificial Sequence; identical to SEQ ID NO: 101396
  derived and/or modified sequence opt2 from hemagglutinin__InfluenzaA__AGG13675

SEQ ID NO: 101410 - RNA, 1701 nt, Artificial Sequence; identical to SEQ ID NO: 101395
  derived and/or modified sequence opt2 from hemagglutinin__InfluenzaA__AGG13687

SEQ ID NO: 101411 - RNA, 1701 nt, Artificial Sequence; identical to SEQ ID NO: 101396
  derived and/or modified sequence opt2 from hemagglutinin__InfluenzaA__AGG13711

SEQ ID NO: 101412 - RNA, 1701 nt, Artificial Sequence; identical to SEQ ID NO: 101395
  derived and/or modified sequence opt2 from hemagglutinin__InfluenzaA__AGG13723

SEQ ID NO: 101413 - RNA, 1701 nt, Artificial Sequence; identical to SEQ ID NO: 101395
  derived and/or modified sequence opt2 from hemagglutinin__InfluenzaA__AGG13735

SEQ ID NO: 101414 - RNA, 1701 nt, Artificial Sequence; identical to SEQ ID NO: 101395
  derived and/or modified sequence opt2 from hemagglutinin__InfluenzaA__AGG13747

SEQ ID NO: 101415 - RNA, 1701 nt, Artificial Sequence
  derived and/or modified sequence opt2 from hemagglutinin__InfluenzaA__AGG13759
augaagaccaucaucgcccucuccuacauccucugccucgucuucgcccaggagcuccccggcaacgacgacuccaccgccacccucugccucggccaccacgccguccccaacggcaccaucgucaagaccaucaccaacgaccgcaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101416 - RNA, 1701 nt, Artificial Sequence
  derived and/or modified sequence opt2 from hemagglutinin__InfluenzaA__AGG13771
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccgacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaguccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaacaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101417 - RNA, 1701 nt, Artificial Sequence
  derived and/or modified sequence opt2 from hemagglutinin__InfluenzaA__AGG13783
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaugggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacguccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101418 - RNA, 1701 nt, Artificial Sequence; identical to SEQ ID NO: 101396
  derived and/or modified sequence opt2 from hemagglutinin__InfluenzaA__AGG13795

SEQ ID NO: 101419 - RNA, 1701 nt, Artificial Sequence; identical to SEQ ID NO: 101347
  derived and/or modified sequence opt2 from hemagglutinin__InfluenzaA__AGG13807

SEQ ID NO: 101420 - RNA, 1701 nt, Artificial Sequence; identical to SEQ ID NO: 101396
  derived and/or modified sequence opt2 from hemagglutinin__InfluenzaA__AGG13819

SEQ ID NO: 101421 - RNA, 1701 nt, Artificial Sequence; identical to SEQ ID NO: 101396
  derived and/or modified sequence opt2 from hemagglutinin__InfluenzaA__AGG13831

SEQ ID NO: 101422 - RNA, 1701 nt, Artificial Sequence; identical to SEQ ID NO: 101395
  derived and/or modified sequence opt2 from hemagglutinin__InfluenzaA__AGG13855

SEQ ID NO: 101423 - RNA, 1701 nt, Artificial Sequence
  derived and/or modified sequence opt2 from hemagglutinin__InfluenzaA__AGG13867
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcaagaucugcgacuccccccaccagauccucgacggcgagaacugcacccucauggacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101424 - RNA, 1701 nt, Artificial Sequence; identical to SEQ ID NO: 101395
  derived and/or modified sequence opt2 from hemagglutinin__InfluenzaA__AGG13879

SEQ ID NO: 101425 - RNA, 1701 nt, Artificial Sequence; identical to SEQ ID NO: 101395
  derived and/or modified sequence opt2 from hemagglutinin__InfluenzaA__AGG13891

SEQ ID NO: 101426 - RNA, 1701 nt, Artificial Sequence
  derived and/or modified sequence opt2 from hemagglutinin__InfluenzaA__AGG13903
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccgacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaguccguccuccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101427 - RNA, 1701 nt, Artificial Sequence; identical to SEQ ID NO: 101395
  derived and/or modified sequence opt2 from hemagglutinin__InfluenzaA__AGG13927

SEQ ID NO: 101428 - RNA, 1701 nt, Artificial Sequence; identical to SEQ ID NO: 101403
  derived and/or modified sequence opt2 from hemagglutinin__InfluenzaA__AGG13939

SEQ ID NO: 101429 - RNA, 1701 nt, Artificial Sequence
  derived and/or modified sequence opt2 from hemagglutinin__InfluenzaA__AGG13962
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagggcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucaucgagcccggcgacaagaucaccuucgaggccaccggcaaccucgucgucccccgcuacgccuucgccauggagcgcaacgccgaguccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101430 - RNA, 1701 nt, Artificial Sequence; identical to SEQ ID NO: 101395
  derived and/or modified sequence opt2 from hemagglutinin__InfluenzaA__AGG13973

SEQ ID NO: 101431 - RNA, 1701 nt, Artificial Sequence; identical to SEQ ID NO: 101395
  derived and/or modified sequence opt2 from hemagglutinin__InfluenzaA__AGG13985

SEQ ID NO: 101432 - RNA, 1701 nt, Artificial Sequence; identical to SEQ ID NO: 101395
  derived and/or modified sequence opt2 from hemagglutinin__InfluenzaA__AGG13997

SEQ ID NO: 101433 - RNA, 1701 nt, Artificial Sequence; identical to SEQ ID NO: 101395
  derived and/or modified sequence opt2 from hemagglutinin__InfluenzaA__AGG14009

SEQ ID NO: 101434 - RNA, 1701 nt, Artificial Sequence
  derived and/or modified sequence opt2 from hemagglutinin__InfluenzaA__AGG14021
augaagaccaucaucgcccucuccuacauccucugccucgucuucgcccaggagcuccccggcaacgacgacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcaucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101435 - RNA, 1701 nt, Artificial Sequence; identical to SEQ ID NO: 101396
  derived and/or modified sequence opt2 from hemagglutinin__InfluenzaA__AGG14033

SEQ ID NO: 101436 - RNA, 1701 nt, Artificial Sequence; identical to SEQ ID NO: 101415
  derived and/or modified sequence opt2 from hemagglutinin__InfluenzaA__AGG14318

SEQ ID NO: 101437 - RNA, 1701 nt, Artificial Sequence
  derived and/or modified sequence opt2 from hemagglutinin__InfluenzaA__AGG14330
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucauccgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101438 - RNA, 1701 nt, Artificial Sequence
  derived and/or modified sequence opt2 from hemagglutinin__InfluenzaA__AGG84179
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccgccuccgagaucugcgacuccccccaccacauccucgacggcgagaacugcacccucaucgacgcccuccucggcgacccccagugcgacggcuuccagaacaagaagugggaccucuucgucgagcgcucccgcgccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101439 - RNA, 1704 nt, Artificial Sequence
  derived and/or modified sequence opt2 from hemagglutinin__InfluenzaA__AGI02564
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccaccaacgaccucugcuaccccggcaacuucaacgacuacgaggagcucaagcaccuccucucccgcaucaaccacuucgagaagauccagaucauccccaaguccuccugguccggccacgaggccuccuccggcgucuccuccgccugccccuaccagggcacccccuccuucuuccgcaacgucgucuggcucaucaagaagaacaacaccuaccccaccaucaagcgcuccuacaacaacaccaaccaggaggaccuccucauccucuggggcauccaccacuccaacgacgccgccgagcagaccaagcucuaccagaaccccaccaccuacaucuccgucggcaccuccacccucaaccagcgccucguccccaagaucgccacccgcuccaaggucaacggccaguccggccgcauggacuucuucuggaccauccucaagcccaacgacgccaucaacuucgaguccaacggcaacuucaucgcccccgaguacgccuacaagaucgucaagaagggcgacuccgccaucaugaaguccgaggucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcaacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 101440 - RNA, 1707 nt, Artificial Sequence
  derived and/or modified sequence opt2 from hemagglutinin__InfluenzaA__AGI02565
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccauccccgccaacgaccucugcuaccccggcgacuucaacgacuacgaggagcucaagcaccuccucucccgcaucaaccacuucgagaagauccagaucauccccaaguccuccugguccaaccacgaggccucccucggcgucuccuccgccugccccuaccucggcaagcccuccuucuuccgcaacgucgucuggcucaucaagaagaacuccaccuaccccaccaucaagcgcuccuacaacaacaccaaccaggaggaccuccucguccucuggggcauccaccaccccaacgacgccgccgagcagaccaagcucuaccagaaccccaccaccuacaucuccgucggcaccuccacccucaaccagcgccucguccccaagaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccgccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 101441 - RNA, 1704 nt, Artificial Sequence
  derived and/or modified sequence opt2 from hemagglutinin__InfluenzaA__AGI02566
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggcacccccuccuucuuccgcaacgucgucuggcucaucaagaagaacaacaccuaccccaccaucaagcgcuccuacaacaacaccaaccaggagaaccuccucauccucuggggcauccaccacuccaacgacgccgccgagcagaucaagcucuaccagaaccccaccaccuacaucuccgucggcaccuccacccucaaccagcgccucguccccaagaucgccacccgcuccaaggucaacggccaguccggccgcauggacuucuucuggaccauccucaagcccaacgacgccaucaacuucgaguccaacggcaacuucaucgcccccgaguacgccuacaagaucgucaaggagggcgacuccgccaucaugaaguccgaggucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 101442 - RNA, 1707 nt, Artificial Sequence
  derived and/or modified sequence opt2 from hemagglutinin__InfluenzaA__AGI02567
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguuccucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggccgcuccuccuucuuccgcaacgucgucuggcucaucaagaagaacaacgccuaccccaccaucaagcgcuccuacaacaacaccaaccaggaggaccuccucguccucuggggcauccaccaccccaacgacgccgccgagcagacccgccucuaccagaaccccaccaccuacaucuccgucggcaccuccacccucaaccagcgccucguccccaagaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccaccaucaugaaguccgagcucgaguacggcaacugcaacaccaagugccagacccccaucggcgccaucaacuccuccaugcccuuccacaacauccacccccucaccaucggcgagugccccaaguacgucaaguccaaccgccucguccucgccaccggccuccgcaacuccccccagggcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccaccgcugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucauggucgccggccucucccucuggaugugcuccaacggcucccuccagugccgcaucugcaucuga

SEQ ID NO: 101443 - RNA, 1704 nt, Artificial Sequence
  derived and/or modified sequence opt2 from hemagglutinin__InfluenzaA__AGI02568
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaguccuccugguccgaccacgaggccuccuccggcgucuccuccgccugccccuaccagggcacccccuccuucuuccgcaacgucgucuggcucaucaagaagaacaacaccuaccccaccaucaagcgcuccuacaacaacaccaaccaggagaaccuccucauccucuggggcauccaccacuccaacgacgccaccgagcagaucaagcucuaccagaaccccaccaccuacaucuccgucggcaccuccacccucaaccagcgccucguccccaagaucggcacccgcuccaaggucaacggccaguccggccgcauggacuucuucuggaccauccucaagcccaacgacgccaucaacuucgaguccaacggcaacuucaucgcccccgaguacgccuacaagaucgucaaggagggcgacuccgccaucaugaaguccgaggucgaguacggcaacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaugggcaucuaccagauccucuccaucuacuccaccgucgccuccucccucgcccucgccaucauggucgccggccucucccucuggaugugcuccaacggcucccuccagugccgcaucugcaucuga

SEQ ID NO: 101444 - RNA, 1683 nt, Artificial Sequence
  derived and/or modified sequence opt2 from hemagglutinin__InfluenzaA__AGI60301
augaacacccagauccucgucuucgcccucaucgccaucauccccaccaacgccgacaagaucugccucggccaccacgccgucuccaacggcaccaaggucaacacccucaccgagcgcggcgucgaggucgucaacgccaccgagaccgucgagcgcaccaacaucccccgcaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggaggccaugggcuucaccuacuccggcauccgcaccaacggcgccaccuccgccugccgccgcuccggcuccuccuucuacgccgagaugaaguggcuccucuccaacaccgacaacgccgccuucccccagaugaccaaguccuacaagaacacccgcaagucccccgcccucaucgucuggggcauccaccacuccgucuccaccgccgagcagaccaagcucuacggcuccggcaacaagcucgucaccgucggcuccuccaacuaccagcaguccuucguccccucccccggcgcccgcccccaggucaacggcaucuccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacuccggcggcaccaucaucuccaaccuccccuuccagaacaucgacucccgcgccgucggcaagugcccccgcuacgucaagcagcgcucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucgaccagaucaccggcaagcucaaccgccucaucgagaagaccaaccagcaguucgagcucaucgacaacgaguucaacgaggucgagaagcagaucggcaacgucaucaacuggacccgcgacuccaucaccgaggucugguccuacaacgccgagcuccucgucgccauggagaaccagcacaccaucgaccucgccgacuccgagauggacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgucaugggccucgucuucaucugcgucaagaacggcaacaugcgcugcaccaucugcaucuga

SEQ ID NO: 101445 - RNA, 1683 nt, Artificial Sequence
  derived and/or modified sequence opt2 from hemagglutinin__InfluenzaA__AGJ72861
augaacacccagauccucgucuucgcccucaucgccaucauccccaccaacgccgacaagaucugccucggccaccacgccgucuccaacggcaccaaggucaacacccucaccgagcgcggcggcgaggucgucaacgccaccgagaccgucgagcgcaccaacaucccccgcaucugcuccaagggcaagaagaccgucgaccucggccagggcggcccccgcggcaccaucaccggccccccccagugcgaccaguuccucgaguucuccgccgaccucaucauggagcgccgcgagggcuccgacgucugcuaccccggcaaguucgucaacgaggaggcccuccgccagauccuccgcgaguccggcggcaucgacaaggaggccaugggcuucaccuacuccggcauccgcaccaacggcgccaccuccgccugccgccgcuccggcuccuccuucuacgccgagaugaaguggcuccucuccaacaccgacaacgccgccuucccccagaugaccaaguccuacaagaacacccgcaagucccccgcccucaucgucuggggcauccaccacuccgucuccaccgccgagcagaccaagcucuacggcuccggcaacaagcucgucaccgucggcuccuccaacuaccagcaguccuucguccccucccccggcgcccgcccccaggucaacggccaguccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacuccggcggcaccaucaucuccaaccuccccuuccagaacaucgacucccgcgccgucggcaagugcccccgcuacgucaagcagcgcucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucgaccagaucaccggcaagcucaaccgccucaucgagaagaccaaccagcaguucgagcucaucgacaacgaguucaacgaggucgagaagcagaucggcaacgucaucaacuggacccgcgacuccaucaccgaggucugguccuacaacgccgagcuccucgucgccauggagaaccagcacaccaucgaccucgccgacuccgagauggacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgucaugggccucgucuucaucugcgucaagaacggcaacaugcgcugcaccaucugcaucuga

SEQ ID NO: 101446 - RNA, 1701 nt, Artificial Sequence
  derived and/or modified sequence opt2 from hemagglutinin__InfluenzaA__AGJ73327
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccaccagucccucuaccagaacgccgacgccuacgucuucgucggcaccucccgcuacuccaagaaguucaagcccgagaucgccauccgccccaagguccgcgaccaggagggccgcaugaacuacuacuggacccucaucgagcccggcgacaagaucaccuucgaggccaccggcaaccucgucgucccccgcuacgccuucgccauggagcgcaacgccggcuccggcaucaucauccccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaagcucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgagaucuccuucuggaugugcuccaacggcucccuccagugccgcaucugcaucuga

SEQ ID NO: 101447 - RNA, 1701 nt, Artificial Sequence
  derived and/or modified sequence opt2 from hemagglutinin__InfluenzaA__AGJ73329
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacgcccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101448 - RNA, 1701 nt, Artificial Sequence
  derived and/or modified sequence opt2 from hemagglutinin__InfluenzaA__AGJ73331
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccaccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccacccccccaccuccgccgaccagcagucccucuaccagaacgccgacgccuacgucuucgucggcaccucccgcuacuccaagaaguucaagcccgagaucgccauccgccccaagguccgcggccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaaggucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101449 - RNA, 1701 nt, Artificial Sequence
  derived and/or modified sequence opt2 from hemagglutinin__InfluenzaA__AGJ73333
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101450 - RNA, 1701 nt, Artificial Sequence
  derived and/or modified sequence opt2 from hemagglutinin__InfluenzaA__AGJ73335
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagccccgcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101451 - RNA, 1701 nt, Artificial Sequence; identical to SEQ ID NO: 97966
  derived and/or modified sequence opt2 from hemagglutinin__InfluenzaA__AGJ73337

SEQ ID NO: 101452 - RNA, 1701 nt, Artificial Sequence; identical to SEQ ID NO: 97966
  derived and/or modified sequence opt2 from hemagglutinin__InfluenzaA__AGJ73339

SEQ ID NO: 101453 - RNA, 1701 nt, Artificial Sequence; identical to SEQ ID NO: 97966
  derived and/or modified sequence opt2 from hemagglutinin__InfluenzaA__AGJ73341

SEQ ID NO: 101454 - RNA, 1701 nt, Artificial Sequence
  derived and/or modified sequence opt2 from hemagglutinin__InfluenzaA__AGJ73343
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcagaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccguccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101455 - RNA, 1701 nt, Artificial Sequence
  derived and/or modified sequence opt2 from hemagglutinin__InfluenzaA__AGJ73345
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgaggacgccuacgucuucgucggcaccuccaaguacuccaagaaguucaagcccgagaucgccguccgccccaagguccgcgaccaggagggccgcaugaacuacuacuggacccucgucgagcccggcaacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101456 - RNA, 1701 nt, Artificial Sequence; identical to SEQ ID NO: 98562
  derived and/or modified sequence opt2 from hemagglutinin__InfluenzaA__AGJ73347

SEQ ID NO: 101457 - RNA, 1701 nt, Artificial Sequence; identical to SEQ ID NO: 98562
  derived and/or modified sequence opt2 from hemagglutinin__InfluenzaA__AGJ73349

SEQ ID NO: 101458 - RNA, 1701 nt, Artificial Sequence
  derived and/or modified sequence opt2 from hemagglutinin__InfluenzaA__AGJ73351
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagaugcgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101459 - RNA, 1701 nt, Artificial Sequence
  derived and/or modified sequence opt2 from hemagglutinin__InfluenzaA__AGJ73353
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccguccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccaguccauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101460 - RNA, 1701 nt, Artificial Sequence
  derived and/or modified sequence opt2 from hemagglutinin__InfluenzaA__AGJ73355
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaccuccuucuggaugugcuccaacggcucccuccagugccgcaucugcaucuga

SEQ ID NO: 101461 - RNA, 1701 nt, Artificial Sequence; identical to SEQ ID NO: 98379
  derived and/or modified sequence opt2 from hemagglutinin__InfluenzaA__AGJ73357

SEQ ID NO: 101462 - RNA, 1701 nt, Artificial Sequence
  derived and/or modified sequence opt2 from hemagglutinin__InfluenzaA__AGJ73361
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccuccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucuucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101463 - RNA, 1701 nt, Artificial Sequence; identical to SEQ ID NO: 98562
  derived and/or modified sequence opt2 from hemagglutinin__InfluenzaA__AGJ73363

SEQ ID NO: 101464 - RNA, 1701 nt, Artificial Sequence; identical to SEQ ID NO: 98379
  derived and/or modified sequence opt2 from hemagglutinin__InfluenzaA__AGJ73365

SEQ ID NO: 101465 - RNA, 1701 nt, Artificial Sequence
  derived and/or modified sequence opt2 from hemagglutinin__InfluenzaA__AGJ73367
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccuggcccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucgccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccguccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccaggacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101466 - RNA, 1701 nt, Artificial Sequence
  derived and/or modified sequence opt2 from hemagglutinin__InfluenzaA__AGJ73369
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgccgaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101467 - RNA, 1701 nt, Artificial Sequence; identical to SEQ ID NO: 97966
  derived and/or modified sequence opt2 from hemagglutinin__InfluenzaA__AGJ73371

SEQ ID NO: 101468 - RNA, 1701 nt, Artificial Sequence
  derived and/or modified sequence opt2 from hemagglutinin__InfluenzaA__AGJ73373
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccaccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101469 - RNA, 1701 nt, Artificial Sequence
  derived and/or modified sequence opt2 from hemagglutinin__InfluenzaA__AGJ73375
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccgagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucaucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101470 - RNA, 1701 nt, Artificial Sequence
  derived and/or modified sequence opt2 from hemagglutinin__InfluenzaA__AGJ73377
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccuccugcccccgcgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucaaccacaagugcgacaacaccugcauggaguccgucaagaacggcaccuacgacuaccccaaguacuccgaggaggccaagcucaacaaggaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101471 - RNA, 1701 nt, Artificial Sequence
  derived and/or modified sequence opt2 from hemagglutinin__InfluenzaA__AGJ73380
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcggccaggagggccgcaugaacuacuacuggacccucaucgagcccggcgacaagaucaccuucgaggccaccggcaaccucgucgucccccgcuacgccuucgccauggagcgcaacgccggcuccggcaucaucaucuccgacacccccguccacgacugcaacuccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcucuucguccuccucgagaacgagcgcacccucgacuaccacgacuccaacgucaaggaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101472 - RNA, 1701 nt, Artificial Sequence
  derived and/or modified sequence opt2 from hemagglutinin__InfluenzaA__AGK62991
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101473 - RNA, 1701 nt, Artificial Sequence
  derived and/or modified sequence opt2 from hemagglutinin__InfluenzaA__AGK62993
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucuccaagugcaacuccgccugcaucaccaccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugguccugccagaagggcaacauccgcugcaacaucugcaucuga

SEQ ID NO: 101474 - RNA, 1701 nt, Artificial Sequence
  derived and/or modified sequence opt2 from hemagglutinin__InfluenzaA__AGK62995
augaagaccaucaucgcccucuccuacauccucugccucgucuucgcccagaagcuccccggcaacgacaacuccaccgccacccucugccucggccaccacgccggccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101475 - RNA, 1701 nt, Artificial Sequence
  derived and/or modified sequence opt2 from hemagglutinin__InfluenzaA__AGK62997
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgacaaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccugcggcgccugcgcccgcuacgucaagcagaacacccucaagcucgccaccggcaugcgcaacguccccgagaagcagacccgcggcaucuucggcgccaucgccgucuucaucgagaacggcugggagggcauggucgacggcugguacggcuuccgccaccagaacuccgagggccgcgagcaggccgccgccuuccaguccacccaggccgccaucgaccagaucaucggcaagcucaaccgccucaucggcgagaccaacgagaaguuccaccagaucgagaaggaguucuccgaggucgagcgccgcauccaggcccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugguccugccagaagggcaacauccgcugcaacaucugcaucuga

SEQ ID NO: 101476 - RNA, 1701 nt, Artificial Sequence
  derived and/or modified sequence opt2 from hemagglutinin__InfluenzaA__AGK62999
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101477 - RNA, 1701 nt, Artificial Sequence
  derived and/or modified sequence opt2 from hemagglutinin__InfluenzaA__AGK63001
augaagaccaucaucgcccucuccuacauccucugccucgucuucgcccagaagcuccccggcaacgacaacuccaccgccacccucugccucguccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacggccucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcgagcaggccgccgacuuccaguccacccaggccgccaucgaccagaucaucggcaagcucaaccgccucaucggcaagaccaacgagaaguuccaccagaucgagaaggaguucuccgaggucgagcgccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugguccugccagaagggcaacauccgcugcaacaucugcaucuga

SEQ ID NO: 101478 - RNA, 1701 nt, Artificial Sequence
  derived and/or modified sequence opt2 from hemagglutinin__InfluenzaA__AGK63003
augaagaccaucaucgcccucuccuacauccucugccucgucuucgcccagaagcuccccggcaacgacaacuccaccgccacccucugccucggccaccacgccggccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucaucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101479 - RNA, 1701 nt, Artificial Sequence
  derived and/or modified sequence opt2 from hemagglutinin__InfluenzaA__AGK63005
augaagaccaucaucgcccucuccuacauccucugccucgucuucgcccagaagcuccccggcaacgacaacuccaccgccacccucugccucguccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacggccucacccaccucaacuucaaguaccccgcccucgacgucaccaugcccaacaacgacaaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccgucuucaucgagaacggcugggagggcauggucgacggcugguacggcuuccgccaccagaacuccgagggccgcgagcaggccgccgacuuccaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101480 - RNA, 1701 nt, Artificial Sequence
  derived and/or modified sequence opt2 from hemagglutinin__InfluenzaA__AGK63007
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101481 - RNA, 1701 nt, Artificial Sequence
  derived and/or modified sequence opt2 from hemagglutinin__InfluenzaA__AGK63009
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggccuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101482 - RNA, 1701 nt, Artificial Sequence
  derived and/or modified sequence opt2 from hemagglutinin__InfluenzaA__AGK63011
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101483 - RNA, 1701 nt, Artificial Sequence
  derived and/or modified sequence opt2 from hemagglutinin__InfluenzaA__AGK63013
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucgacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcgcccgcuacgucaagcagaacacccucaagcucgccaccggcaugcgcaacguccccgagaagcagacccgcggcaucuucggcgccaucgccgucuucaucgagaacggcugggagggcauggucgacggcugguacggcuuccgccaccagaacuccgagggccgcggccaggccgccgcccuccaguccacccaggccgccaucgaccagaucaccggcaagcucaaccgccucaucggcgagaccaacgagaaguuccaccagaucgagaaggaguucuccgaggucgagggccgcauccaggcccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugguccugccagaagggcaacauccgcugcaacaucugcaucuga

SEQ ID NO: 101484 - RNA, 1701 nt, Artificial Sequence
  derived and/or modified sequence opt2 from hemagglutinin__InfluenzaA__AGK63015
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101485 - RNA, 1701 nt, Artificial Sequence; identical to SEQ ID NO: 98494
  derived and/or modified sequence opt2 from hemagglutinin__InfluenzaA__AGK63017

SEQ ID NO: 101486 - RNA, 1701 nt, Artificial Sequence
  derived and/or modified sequence opt2 from hemagglutinin__InfluenzaA__AGK63019
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101487 - RNA, 1701 nt, Artificial Sequence; identical to SEQ ID NO: 101361
  derived and/or modified sequence opt2 from hemagglutinin__InfluenzaA__AGK63021

SEQ ID NO: 101488 - RNA, 1701 nt, Artificial Sequence
  derived and/or modified sequence opt2 from hemagglutinin__InfluenzaA__AGK63025
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucaucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101489 - RNA, 1701 nt, Artificial Sequence; identical to SEQ ID NO: 100586
  derived and/or modified sequence opt2 from hemagglutinin__InfluenzaA__AGK63027

SEQ ID NO: 101490 - RNA, 1701 nt, Artificial Sequence
  derived and/or modified sequence opt2 from hemagglutinin__InfluenzaA__AGK63029
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucaccaccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101491 - RNA, 1701 nt, Artificial Sequence
  derived and/or modified sequence opt2 from hemagglutinin__InfluenzaA__AGK63031
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaagaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaucaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaagcuccaccagaucgagaaggaguucuccgaggucgagggccgcauccucgaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101492 - RNA, 1701 nt, Artificial Sequence
  derived and/or modified sequence opt2 from hemagglutinin__InfluenzaA__AGK63033
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucaucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101493 - RNA, 1701 nt, Artificial Sequence
  derived and/or modified sequence opt2 from hemagglutinin__InfluenzaA__AGK63035
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101494 - RNA, 1701 nt, Artificial Sequence
  derived and/or modified sequence opt2 from hemagglutinin__InfluenzaA__AGK63037
augaagaccaucaucgcccucuccuacauccucugccucgucuucgcccaggagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcaaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgcccagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101495 - RNA, 1701 nt, Artificial Sequence
  derived and/or modified sequence opt2 from hemagglutinin__InfluenzaA__AGK63039
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaagaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucacccuccccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucuccaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugguccugccagaagggcaacauccgcugcaacaucugcaucuga

SEQ ID NO: 101496 - RNA, 1701 nt, Artificial Sequence
  derived and/or modified sequence opt2 from hemagglutinin__InfluenzaA__AGK63041
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggccuccagaacaagaagugggaccucaucgucgagcgcuccaaggcccacuccuacugcuaccccuacgacguccccgacuacgccucccuccgcucccucgucgccuccuccggcacccucgaguucaacaacgaguccuucaacuggaccgaggucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101497 - RNA, 1701 nt, Artificial Sequence
  derived and/or modified sequence opt2 from hemagglutinin__InfluenzaA__AGK63043
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101498 - RNA, 1701 nt, Artificial Sequence
  derived and/or modified sequence opt2 from hemagglutinin__InfluenzaA__AGK63045
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaagaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgcccagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101499 - RNA, 1701 nt, Artificial Sequence
  derived and/or modified sequence opt2 from hemagglutinin__InfluenzaA__AGK63047
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccgcgagggccgcaugaacuacuacuggacccucaucgagcccggcgacaagaucaccuucgaggccaccggcaaccucgucgucccccgcuacgccuucgccauggagcgcaacgccggcuccggcaucaucaucuccgacacccccguccacgacugcaacaccgccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101500 - RNA, 1683 nt, Artificial Sequence
  derived and/or modified sequence opt2 from hemagglutinin__InfluenzaA__AGK82158
augaacacccagauccucgucuucgcccucaucgccaucauccccaccaacgccgacaagaucugccucggccaccacgccgucuccaacggcaccaaggucaacacccucaccgagcgcggcgucgaggucgucaacgccaccgagaccgucgagcgcaccaacaucccccgcaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggaggccaugggcuucaccuacuccggcauccgcaccaacggcgccaccuccgccugccgccgcuccggcuccuccuucuacgccgagaugaaguggcuccucuccaacaccgacaacgccgccuucccccagaugaccaaguccuacaagaacacccgcaagucccccgcccucaucgucuggggcauccaccacuccgucuccaccgccgagcagaccaagcucuacggcuccggcaacaagcucgucaccgucggcuccuccaacuaccagcaguccuucguccccucccccggcgcccgcccccaggucaacggccucuccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacuccggcggcaccaucaucuccaaccuccccuuccagaacaucgacucccgcgccgucggcaagugcccccgcuacgucaagcagcgcucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucgaccagaucaccggcaagcucaaccgccucaucgagaagaccaaccagcaguucgagcucaucgacaacgaguucaacgaggucgagaagcagaucggcaacgucaucaacuggacccgcgacuccaucaccgaggucugguccuacaacgccgagcuccucgucgccauggagaaccagcacaccaucgaccucgccgacuccgagauggacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgucaugggccucgucuucaucugcgucaagaacggcaacaugcgcugcaccaucugcaucuga

SEQ ID NO: 101501 - RNA, 1683 nt, Artificial Sequence
  derived and/or modified sequence opt2 from hemagglutinin__InfluenzaA__AGK84857
augaacacccagauccucgucuucgcccucaucgccaucauccccaccaacgccgacaagaucugccucggccaccacgccgucuccaacggcaccaaggucaacacccucaccgagcgcggcgucgaggucgucaacgccaccgagaccgucgagcgcaccaacaucccccgcaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggaggccaugggcuucaccuacuccggcauccgcaccaacggcgccaccuccgccugccgccgcuccggcuccuccuucuacgccgagaugaaguggcuccucuccaacaccgacaacgccgccuucccccagaucaccaaguccuacaagaacacccgcaagucccccgcccucaucgucuggggcauccaccacuccgucuccaccgccgagcagaccaagcucuacggcuccggcaacaagcucgucaccgucggcuccuccaacuaccagcaguccuucguccccucccccggcgcccgcccccaggucaacggccucuccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacuccggcggcaccaucaucuccaaccuccccuuccagaacaucgacucccgcgccgucggcaagugcccccgcuacgucaagcagcgcucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucgaccagaucaccggcaagcucaaccgccucaucgagaagaccaaccagcaguucgagcucaucgacaacgaguucaacgaggucgagaagcagaucggcaacgucaucaacuggacccgcgacuccaucaccgaggucugguccuacaacgccgagcuccucgucgccauggagaaccagcacaccaucgaccucgccgacuccgagauggacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgucaugggccucgucuucaucugcgucaagaacggcaacaugcgcugcaccaucugcaucuga

SEQ ID NO: 101502 - RNA, 1683 nt, Artificial Sequence
  derived and/or modified sequence opt2 from hemagglutinin__InfluenzaA__AGK84860
augaacacccagauccucgucuucgcccucaucgccaucauccccaccaacgccgacaagaucugccucggccaccacgccgucuccaacggcaccaaggucaacacccucaccgagcgcggcgucgaggucgucaacgccaccgagaccgucgagcgcaccaacaucccccgcaucugcuccaagggcaagaugaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggaggccaugggcuucaccuacuccggcauccgcaccaacggcgccaccuccgccugccgccgcuccggcuccuccuucuacgccgagaugaaguggcuccucuccaacaccgacaacgccgccuucccccagaugaccaaguccuacaagaacacccgcaagucccccgcccucaucgucuggggcauccaccacuccgucuccaccgccgagcagaccaagcucuacggcuccggcaacaagcucgucaccgucggcuccuccaacuaccagcaguccuucguccccucccccggcgcccgcccccaggucaacggccucuccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacuccggcggcaccaucaucuccaaccuccccuuccagaacaucgacucccgcgccgucggcaagugcccccgcuacgucaagcagcgcucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucgaccagaucaccggcaagcucaaccgccucaucgagaagaccaaccagcaguucgagcucaucgacaacgaguucaacgaggucgagaagcagaucggcaacgucaucaacuggacccgcgacuccaucaccgaggucugguccuacaacgccgagcuccucgucgccauggagaaccagcacaccaucgaccucgccgacuccgagauggacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgucaugggccucgucuucaucugcgucaagaacggcaacaugcgcugcaccaucugcaucuga

SEQ ID NO: 101503 - RNA, 1683 nt, Artificial Sequence
  derived and/or modified sequence opt2 from hemagglutinin__InfluenzaA__AGK84863
augaacacccagauccucgucuucgcccucaucgccaucauccccaccaacgccgacaagaucugccucggccaccacgccgucuccaacggcaccaaggucaacacccucaccgagcgcggcgucgaggucgucaacgccaccgagaccgucgagcgcaccaacaucccccgcaucugcuccaagggcaagaagaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggaggccaugggcuucaccuacuccggcauccgcaccaacggcgccaccuccgccugccgccgcuccggcuccuccuucuacgccgagaugaaguggcuccucuccaacaccgacaacgccgccuucccccagaugaccaaguccuacaagaacacccgcaagucccccgcccucaucgucuggggcauccaccacuccgucuccaccgccgagcagaccaagcucuacggcuccggcaacaagcucgucaccgucggcuccuccaacuaccagcaguccuucguccccucccccggcgcccgcccccaggucaacggccucuccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacuccggcggcaccaucaucuccaaccuccccuuccagaacaucgacucccgcgccgucggcaagugcccccgcuacgucaagcagcgcucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucgaccagaucaccggcaagcucaaccgccucaucgagaagaccaaccagcaguucgagcucaucgacaacgaguucaacgaggucgagaagcagaucggcaacgucaucaacuggacccgcgacuccaucaccgaggucugguccuacaacgccgagcuccucgucgccauggagaaccagcacaccaucgaccucgccgacuccgagauggacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgucaugggccucgucuucaucugcgucaagaacggcaacaugcgcugcaccaucugcaucuga

SEQ ID NO: 101504 - RNA, 1701 nt, Artificial Sequence
  derived and/or modified sequence opt2 from hemagglutinin__InfluenzaA__AGL07713
augaaggccauccucgucguccuccucuacaccuucgccaccgccaacgccgacacccucugcaucggcuaccacgccaacaacuccaccgacaccgucgacaccguccucgagaagaacgucaccgucacccgcuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccggcuccuggcccaaccacgacuccaacaagggcgucaccgccgccugcccccacgccggcgccaagggcuucuacaagaaccucaucuggcucgucgagaagggcaacuccuaccccaagcucuccaaguccuacaucaacgacaagggcaaggagguccucguccucuggggcauccaccaccccuccaccaccgccgaccagcagcgccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101505 - RNA, 1701 nt, Artificial Sequence
  derived and/or modified sequence opt2 from hemagglutinin__InfluenzaA__AGL09731
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101506 - RNA, 1701 nt, Artificial Sequence
  derived and/or modified sequence opt2 from hemagglutinin__InfluenzaA__AGL09732
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101507 - RNA, 1701 nt, Artificial Sequence
  derived and/or modified sequence opt2 from hemagglutinin__InfluenzaA__AGL09734
augaagaccaucaucgcccucuccuacauccucugccucgucuucgcccagaaguuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucaucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101508 - RNA, 1701 nt, Artificial Sequence
  derived and/or modified sequence opt2 from hemagglutinin__InfluenzaA__AGL09735
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucuccaucuga

SEQ ID NO: 101509 - RNA, 1701 nt, Artificial Sequence
  derived and/or modified sequence opt2 from hemagglutinin__InfluenzaA__AGL09736
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101510 - RNA, 1701 nt, Artificial Sequence; identical to SEQ ID NO: 101395
  derived and/or modified sequence opt2 from hemagglutinin__InfluenzaA__AGL09737

SEQ ID NO: 101511 - RNA, 1701 nt, Artificial Sequence
  derived and/or modified sequence opt2 from hemagglutinin__InfluenzaA__AGL09739
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccuccugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101512 - RNA, 1701 nt, Artificial Sequence; identical to SEQ ID NO: 101347
  derived and/or modified sequence opt2 from hemagglutinin__InfluenzaA__AGL09740

SEQ ID NO: 101513 - RNA, 1701 nt, Artificial Sequence; identical to SEQ ID NO: 100586
  derived and/or modified sequence opt2 from hemagglutinin__InfluenzaA__AGL09741

SEQ ID NO: 101514 - RNA, 1701 nt, Artificial Sequence
  derived and/or modified sequence opt2 from hemagglutinin__InfluenzaA__AGL09742
augaagaccaucaucgcccucuccuacauccucugccucgucuucgcccaggagcuccccggcaacgacgacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagacccagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcuccgcuccggcuacaaggacuggauccucuggaucuccuucgccaucuccugcuuccuccucugcgucgcccuccucggcuucaucaugugggccugccagaagggcaacauccgcugcuccaucugcaucuga

SEQ ID NO: 101515 - RNA, 1701 nt, Artificial Sequence; identical to SEQ ID NO: 101370
  derived and/or modified sequence opt2 from hemagglutinin__InfluenzaA__AGL09744

SEQ ID NO: 101516 - RNA, 1701 nt, Artificial Sequence
  derived and/or modified sequence opt2 from hemagglutinin__InfluenzaA__AGL09745
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacgucggcaacggcugcuucaagaucuaccacaagugcgacaacaccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101517 - RNA, 1701 nt, Artificial Sequence; identical to SEQ ID NO: 101509
  derived and/or modified sequence opt2 from hemagglutinin__InfluenzaA__AGL09746

SEQ ID NO: 101518 - RNA, 1701 nt, Artificial Sequence; identical to SEQ ID NO: 101347
  derived and/or modified sequence opt2 from hemagglutinin__InfluenzaA__AGL09747

SEQ ID NO: 101519 - RNA, 1701 nt, Artificial Sequence; identical to SEQ ID NO: 101370
  derived and/or modified sequence opt2 from hemagglutinin__InfluenzaA__AGL09748

SEQ ID NO: 101520 - RNA, 1701 nt, Artificial Sequence; identical to SEQ ID NO: 101368
  derived and/or modified sequence opt2 from hemagglutinin__InfluenzaA__AGL09749

SEQ ID NO: 101521 - RNA, 1701 nt, Artificial Sequence; identical to SEQ ID NO: 101506
  derived and/or modified sequence opt2 from hemagglutinin__InfluenzaA__AGL09750

SEQ ID NO: 101522 - RNA, 1701 nt, Artificial Sequence; identical to SEQ ID NO: 101347
  derived and/or modified sequence opt2 from hemagglutinin__InfluenzaA__AGL09751

SEQ ID NO: 101523 - RNA, 1701 nt, Artificial Sequence; identical to SEQ ID NO: 101506
  derived and/or modified sequence opt2 from hemagglutinin__InfluenzaA__AGL09753

SEQ ID NO: 101524 - RNA, 1701 nt, Artificial Sequence
  derived and/or modified sequence opt2 from hemagglutinin__InfluenzaA__AGL09754
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugccuccuccucugcgucgcccuccucggcuucaucaugugggccugccagaagggcaacauccgcugcaacaucugcaucuga

SEQ ID NO: 101525 - RNA, 1701 nt, Artificial Sequence; identical to SEQ ID NO: 101509
  derived and/or modified sequence opt2 from hemagglutinin__InfluenzaA__AGL09756

SEQ ID NO: 101526 - RNA, 1701 nt, Artificial Sequence
  derived and/or modified sequence opt2 from hemagglutinin__InfluenzaA__AGL09758
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagaucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaacuccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacaccaccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaugugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101527 - RNA, 1701 nt, Artificial Sequence
  derived and/or modified sequence opt2 from hemagglutinin__InfluenzaA__AGL09760
augaagaccaucaucgccgucuccuacauccucugccucgucuucgcccaggagcuccccggcaacgacgacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101528 - RNA, 1701 nt, Artificial Sequence; identical to SEQ ID NO: 101380
  derived and/or modified sequence opt2 from hemagglutinin__InfluenzaA__AGL09761

SEQ ID NO: 101529 - RNA, 1701 nt, Artificial Sequence
  derived and/or modified sequence opt2 from hemagglutinin__InfluenzaA__AGL09762
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101530 - RNA, 1701 nt, Artificial Sequence; identical to SEQ ID NO: 101506
  derived and/or modified sequence opt2 from hemagglutinin__InfluenzaA__AGL09763

SEQ ID NO: 101531 - RNA, 1701 nt, Artificial Sequence
  derived and/or modified sequence opt2 from hemagglutinin__InfluenzaA__AGL09764
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccagaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101532 - RNA, 1701 nt, Artificial Sequence; identical to SEQ ID NO: 101370
  derived and/or modified sequence opt2 from hemagglutinin__InfluenzaA__AGL09765

SEQ ID NO: 101533 - RNA, 1701 nt, Artificial Sequence
  derived and/or modified sequence opt2 from hemagglutinin__InfluenzaA__AGL09766
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccucuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101534 - RNA, 1701 nt, Artificial Sequence
  derived and/or modified sequence opt2 from hemagglutinin__InfluenzaA__AGL09767
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101535 - RNA, 1701 nt, Artificial Sequence
  derived and/or modified sequence opt2 from hemagglutinin__InfluenzaA__AGL09769
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101536 - RNA, 1701 nt, Artificial Sequence; identical to SEQ ID NO: 101370
  derived and/or modified sequence opt2 from hemagglutinin__InfluenzaA__AGL09770

SEQ ID NO: 101537 - RNA, 1701 nt, Artificial Sequence
  derived and/or modified sequence opt2 from hemagglutinin__InfluenzaA__AGL09771
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacaucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101538 - RNA, 1701 nt, Artificial Sequence
  derived and/or modified sequence opt2 from hemagglutinin__InfluenzaA__AGL09772
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccgccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacuacgucuaccgcgacgaggcccucaacaaccgcuuccagaucaagggcgucgagcucaaguccggcuacaaggacuggauccucuggaucuccuucgccaccuccugcuuccuccucugcgucgcccuccucggcuucaucaugugggccugccagaagggcaacauccgcugcaacaucugcaucuga

SEQ ID NO: 101539 - RNA, 1701 nt, Artificial Sequence
  derived and/or modified sequence opt2 from hemagglutinin__InfluenzaA__AGL09773
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccgaggucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccgccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacuacgucuaccgcgacgaggcccucaacaaccgcuuccagaucaagggcgucgagcucaaguccggcuacaaggacuggauccucuggaucuccuucgccaccuccugcuuccuccucugcgucgcccuccucggcuucaucaugugggccugccagaagggcaacauccgcugcaacaucugcaucuga

SEQ ID NO: 101540 - RNA, 1701 nt, Artificial Sequence; identical to SEQ ID NO: 101538
  derived and/or modified sequence opt2 from hemagglutinin__InfluenzaA__AGL09774

SEQ ID NO: 101541 - RNA, 1701 nt, Artificial Sequence; identical to SEQ ID NO: 101380
  derived and/or modified sequence opt2 from hemagglutinin__InfluenzaA__AGL09775

SEQ ID NO: 101542 - RNA, 1701 nt, Artificial Sequence; identical to SEQ ID NO: 101538
  derived and/or modified sequence opt2 from hemagglutinin__InfluenzaA__AGL09776

SEQ ID NO: 101543 - RNA, 1701 nt, Artificial Sequence; identical to SEQ ID NO: 101538
  derived and/or modified sequence opt2 from hemagglutinin__InfluenzaA__AGL09777

SEQ ID NO: 101544 - RNA, 1701 nt, Artificial Sequence
  derived and/or modified sequence opt2 from hemagglutinin__InfluenzaA__AGL09778
augaagaccaucaucgcccucuccuacauccucugccucaucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101545 - RNA, 1701 nt, Artificial Sequence
  derived and/or modified sequence opt2 from hemagglutinin__InfluenzaA__AGL09779
augaagaccaucaucgcccucuccuacauccucugccucgucuucgcccagaagcuccccggcaacaacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101546 - RNA, 1701 nt, Artificial Sequence
  derived and/or modified sequence opt2 from hemagglutinin__InfluenzaA__AGL09780
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucgacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucucccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101547 - RNA, 1701 nt, Artificial Sequence; identical to SEQ ID NO: 101505
  derived and/or modified sequence opt2 from hemagglutinin__InfluenzaA__AGL09781

SEQ ID NO: 101548 - RNA, 1701 nt, Artificial Sequence; identical to SEQ ID NO: 101370
  derived and/or modified sequence opt2 from hemagglutinin__InfluenzaA__AGL09782

SEQ ID NO: 101549 - RNA, 1701 nt, Artificial Sequence
  derived and/or modified sequence opt2 from hemagglutinin__InfluenzaA__AGL09783
augaagaccaucaucgcccucuccuacauccucugccucgucuucgcccagaagcuccccggcaacgacaacuccaccgccacccucugccucggccaccacgccguccccaacggcaccgucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcacccagaaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 101550 - RNA, 1701 nt, Artificial Sequence; identical to SEQ ID NO: 101380
  derived and/or modified sequence opt2 from hemagglutinin__InfluenzaA__AGL09785

SEQ ID NO: 101551 - RNA, 1701 nt, Artificial Sequence
  derived and/or modified sequence opt2 from hemagglutinin__InfluenzaA__AGL09786
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucgacaacgaguccuucaacugggccggcgucacccagaacggcaccuccuccgccugcauccgcggcuccaaguccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucucccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101552 - RNA, 1701 nt, Artificial Sequence
  derived and/or modified sequence opt2 from hemagglutinin__InfluenzaA__AGL09787
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101553 - RNA, 1701 nt, Artificial Sequence; identical to SEQ ID NO: 101552
  derived and/or modified sequence opt2 from hemagglutinin__InfluenzaA__AGL09788

SEQ ID NO: 101554 - RNA, 1701 nt, Artificial Sequence; identical to SEQ ID NO: 101552
  derived and/or modified sequence opt2 from hemagglutinin__InfluenzaA__AGL09789

SEQ ID NO: 101555 - RNA, 1701 nt, Artificial Sequence; identical to SEQ ID NO: 101506
  derived and/or modified sequence opt2 from hemagglutinin__InfluenzaA__AGL09790

SEQ ID NO: 101556 - RNA, 1701 nt, Artificial Sequence
  derived and/or modified sequence opt2 from hemagglutinin__InfluenzaA__AGL09791
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacaugaccaugcccaacaacgagcaguucgacaagcucuacaucuggggcguccaccaccccggcaccgacaaggaccagaucucccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101557 - RNA, 1701 nt, Artificial Sequence; identical to SEQ ID NO: 101506
  derived and/or modified sequence opt2 from hemagglutinin__InfluenzaA__AGL09792

SEQ ID NO: 101558 - RNA, 1701 nt, Artificial Sequence
  derived and/or modified sequence opt2 from hemagglutinin__InfluenzaA__AGL09794
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacacccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101559 - RNA, 1701 nt, Artificial Sequence; identical to SEQ ID NO: 101506
  derived and/or modified sequence opt2 from hemagglutinin__InfluenzaA__AGL09795

SEQ ID NO: 101560 - RNA, 1701 nt, Artificial Sequence
  derived and/or modified sequence opt2 from hemagglutinin__InfluenzaA__AGL09797
augaagaccaucaucgcccucuccuacauccucugccucgucuucucccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101561 - RNA, 1701 nt, Artificial Sequence
  derived and/or modified sequence opt2 from hemagglutinin__InfluenzaA__AGL09798
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuucgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacuacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101562 - RNA, 1701 nt, Artificial Sequence; identical to SEQ ID NO: 101560
  derived and/or modified sequence opt2 from hemagglutinin__InfluenzaA__AGL09799

SEQ ID NO: 101563 - RNA, 1701 nt, Artificial Sequence; identical to SEQ ID NO: 101506
  derived and/or modified sequence opt2 from hemagglutinin__InfluenzaA__AGL09800

SEQ ID NO: 101564 - RNA, 1701 nt, Artificial Sequence; identical to SEQ ID NO: 101370
  derived and/or modified sequence opt2 from hemagglutinin__InfluenzaA__AGL09801

SEQ ID NO: 101565 - RNA, 1701 nt, Artificial Sequence; identical to SEQ ID NO: 101370
  derived and/or modified sequence opt2 from hemagglutinin__InfluenzaA__AGL09802

SEQ ID NO: 101566 - RNA, 1701 nt, Artificial Sequence
  derived and/or modified sequence opt2 from hemagglutinin__InfluenzaA__AGL09803
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcagcgcacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101567 - RNA, 1701 nt, Artificial Sequence; identical to SEQ ID NO: 101403
  derived and/or modified sequence opt2 from hemagglutinin__InfluenzaA__AGL09804

SEQ ID NO: 101568 - RNA, 1701 nt, Artificial Sequence; identical to SEQ ID NO: 101509
  derived and/or modified sequence opt2 from hemagglutinin__InfluenzaA__AGL09805

SEQ ID NO: 101569 - RNA, 1701 nt, Artificial Sequence; identical to SEQ ID NO: 101538
  derived and/or modified sequence opt2 from hemagglutinin__InfluenzaA__AGL09806

SEQ ID NO: 101570 - RNA, 1701 nt, Artificial Sequence; identical to SEQ ID NO: 101509
  derived and/or modified sequence opt2 from hemagglutinin__InfluenzaA__AGL09807

SEQ ID NO: 101571 - RNA, 1701 nt, Artificial Sequence
  derived and/or modified sequence opt2 from hemagglutinin__InfluenzaA__AGL09808
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacgucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101572 - RNA, 1701 nt, Artificial Sequence
  derived and/or modified sequence opt2 from hemagglutinin__InfluenzaA__AGL09809
augaaggccauccucgucgucaugcucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccggcuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaucuccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 101573 - RNA, 1701 nt, Artificial Sequence
  derived and/or modified sequence opt2 from hemagglutinin__InfluenzaA__AGL09810
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucuccaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcaccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaugggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101574 - RNA, 1701 nt, Artificial Sequence; identical to SEQ ID NO: 101370
  derived and/or modified sequence opt2 from hemagglutinin__InfluenzaA__AGL09811

SEQ ID NO: 101575 - RNA, 1701 nt, Artificial Sequence
  derived and/or modified sequence opt2 from hemagglutinin__InfluenzaA__AGL09812
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccaggacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101576 - RNA, 1701 nt, Artificial Sequence; identical to SEQ ID NO: 101347
  derived and/or modified sequence opt2 from hemagglutinin__InfluenzaA__AGL09813

SEQ ID NO: 101577 - RNA, 1701 nt, Artificial Sequence; identical to SEQ ID NO: 101395
  derived and/or modified sequence opt2 from hemagglutinin__InfluenzaA__AGL09814

SEQ ID NO: 101578 - RNA, 1701 nt, Artificial Sequence
  derived and/or modified sequence opt2 from hemagglutinin__InfluenzaA__AGL09815
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcuccauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101579 - RNA, 1701 nt, Artificial Sequence; identical to SEQ ID NO: 101395
  derived and/or modified sequence opt2 from hemagglutinin__InfluenzaA__AGL09816

SEQ ID NO: 101580 - RNA, 1701 nt, Artificial Sequence
  derived and/or modified sequence opt2 from hemagglutinin__InfluenzaA__AGL09817
augaagaccaucaucgcccucuccuacauccucugccucgucuucgcccaggagcuccccggcaacgacgacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacuccgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101581 - RNA, 1701 nt, Artificial Sequence; identical to SEQ ID NO: 101395
  derived and/or modified sequence opt2 from hemagglutinin__InfluenzaA__AGL09818

SEQ ID NO: 101582 - RNA, 1701 nt, Artificial Sequence; identical to SEQ ID NO: 101506
  derived and/or modified sequence opt2 from hemagglutinin__InfluenzaA__AGL09819

SEQ ID NO: 101583 - RNA, 1701 nt, Artificial Sequence
  derived and/or modified sequence opt2 from hemagglutinin__InfluenzaA__AGL09820
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgagaucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101584 - RNA, 1701 nt, Artificial Sequence
  derived and/or modified sequence opt2 from hemagglutinin__InfluenzaA__AGL09821
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcaucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101585 - RNA, 1701 nt, Artificial Sequence; identical to SEQ ID NO: 101509
  derived and/or modified sequence opt2 from hemagglutinin__InfluenzaA__AGL09822

SEQ ID NO: 101586 - RNA, 1701 nt, Artificial Sequence; identical to SEQ ID NO: 101552
  derived and/or modified sequence opt2 from hemagglutinin__InfluenzaA__AGL09823

SEQ ID NO: 101587 - RNA, 1701 nt, Artificial Sequence
  derived and/or modified sequence opt2 from hemagglutinin__InfluenzaA__AGL09824
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcaccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucaucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101588 - RNA, 1701 nt, Artificial Sequence; identical to SEQ ID NO: 101506
  derived and/or modified sequence opt2 from hemagglutinin__InfluenzaA__AGL09825

SEQ ID NO: 101589 - RNA, 1701 nt, Artificial Sequence; identical to SEQ ID NO: 101587
  derived and/or modified sequence opt2 from hemagglutinin__InfluenzaA__AGL09826

SEQ ID NO: 101590 - RNA, 1701 nt, Artificial Sequence; identical to SEQ ID NO: 101380
  derived and/or modified sequence opt2 from hemagglutinin__InfluenzaA__AGL09827

SEQ ID NO: 101591 - RNA, 1701 nt, Artificial Sequence
  derived and/or modified sequence opt2 from hemagglutinin__InfluenzaA__AGL09828
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuaccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101592 - RNA, 1701 nt, Artificial Sequence
  derived and/or modified sequence opt2 from hemagglutinin__InfluenzaA__AGL09829
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucgaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101593 - RNA, 1701 nt, Artificial Sequence; identical to SEQ ID NO: 101395
  derived and/or modified sequence opt2 from hemagglutinin__InfluenzaA__AGL09830

SEQ ID NO: 101594 - RNA, 1701 nt, Artificial Sequence; identical to SEQ ID NO: 101505
  derived and/or modified sequence opt2 from hemagglutinin__InfluenzaA__AGL09831

SEQ ID NO: 101595 - RNA, 1701 nt, Artificial Sequence
  derived and/or modified sequence opt2 from hemagglutinin__InfluenzaA__AGL09832
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcaccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101596 - RNA, 1701 nt, Artificial Sequence; identical to SEQ ID NO: 101506
  derived and/or modified sequence opt2 from hemagglutinin__InfluenzaA__AGL09833

SEQ ID NO: 101597 - RNA, 1701 nt, Artificial Sequence
  derived and/or modified sequence opt2 from hemagglutinin__InfluenzaA__AGL09881
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcgccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101598 - RNA, 1701 nt, Artificial Sequence; identical to SEQ ID NO: 101370
  derived and/or modified sequence opt2 from hemagglutinin__InfluenzaA__AGL09882

SEQ ID NO: 101599 - RNA, 1701 nt, Artificial Sequence; identical to SEQ ID NO: 101347
  derived and/or modified sequence opt2 from hemagglutinin__InfluenzaA__AGL09883

SEQ ID NO: 101600 - RNA, 1701 nt, Artificial Sequence; identical to SEQ ID NO: 101347
  derived and/or modified sequence opt2 from hemagglutinin__InfluenzaA__AGL09884

SEQ ID NO: 101601 - RNA, 1683 nt, Artificial Sequence; identical to SEQ ID NO: 101500
  derived and/or modified sequence opt2 from hemagglutinin__InfluenzaA__AGL44438

SEQ ID NO: 101602 - RNA, 1701 nt, Artificial Sequence
  derived and/or modified sequence opt2 from hemagglutinin__InfluenzaA__AGN69267
augaaggccauccucgucguccuccucuacaccuucaccaccggcaacgccgacacccucugcaucggcuaccacgccaacaacuccaccgacaccgucgacaccguccucgagaagaacgucaccgucacccacuccgucaaccuccucgaggaccgccacaacggcaagcucugcaagcuccgcggcgucgccccccuccaccucggcaagugcaacaucgccggcuggcuccucggcaaccccgagugcgagcuccucuucaccgccuccuccugguccuacaucgucgagaccuccaacuccgacaacggcaccugcuaccccggcgacuucaucaacuacgaggagcuccgcgagcagcucuccuccgucuccuccuucgagcgcuucgagaucuuccccaaggccuccuccuggcccaaccacgagaccaaccgcggcgucaccgccgccugccccuacgccggcgccaacuccuucuaccgcaaccucaucuggcucgucaagaagggcaacuccuaccccaagcucuccaaguccuacaucaacaacaaggagaaggagguccucguccucuggggcauccaccacccccccaccuccaccgaccagcagucccucuaccagaacgccgacgccuacgucuucgucggcuccuccaaguacuccaagaaguucaagcccgagaucgccacccgccccaagguccgcggccaggccggccgcaugaacuacuacuggacccucgucgagcccggcgacaccaucaccuucgaggccaccggcaaccucgucgucccccgcuacgccuucgccaugaagcgcggcuccggcuccggcaucaucaucuccgacacccccguccacgacugcaacaccaccugccagacccccaagggcgccaucaacaccucccuccccuuccagaacauccaccccgucaccaucggcgagugccccaaguacgucaaguccaccaagcuccgcauggccaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccgcaaguccacccagaacgccaucgacggcaucaccaacaaggucaacuccgucaucgagaagaugaacacccaguucaccgccgucggcaaggaguucaaccaccucgagaagcgcaucgagaaccucaacaagaaggucgacgacggccuccucgacgucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacgacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccuccucgucucccucggcgccaucuccuucuggaugugcuccaacggcucccuccagugccgcaucugcaucuga

SEQ ID NO: 101603 - RNA, 1701 nt, Artificial Sequence
  derived and/or modified sequence opt2 from hemagglutinin__InfluenzaA__AGN69278
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgaggaccgccacaacggcaagcucugcaagcuccgcggcgucgccccccuccaccucggcaagugcaacaucgccggcuggcuccucggcaaccccgagugcgagcuccucuucaccgccuccuccugguccuacaucgucgagaccuccaacuccgacaacggcaccugcuaccccggcgacuucaucaacuacgaggagcuccgcgagcagcucuccuccgucuccuccuucgagcgcuucgagaucuuccccaaggccuccuccuggcccaaccacgagcccaaccgcggcgucaccgccgccugccccuacgccggcgccaacuccuucuaccgcaaccucaucuggcucgucaagaagggcaacuccuaccccaagcucuccaaguccuacaucaacaacaaggagaaggagguccucguccucuggggcauccaccacccccccaccuccaccgaccagcagucccucuaccagaacgccgacgccuacgucuucgucggcuccuccaaguacaacaagaaguucaagcccgagaucgccacccgccccaagguccgcggccaggccggccgcaugaacuacuacuggacccucgucgagcccggcgacaccaucaccuucgaggccaccggcaaccucgucgucccccgcuacgccuucgccaugaagcgcggcuccggcuccggcaucaucaucuccgacacccccguccacgacugcaacaccaccugccagacccccaagggcgccaucaacaccucccuccccuuccagaacauccaccccgucaccaucggcgagugccccaaguacgucaaguccaccaagcuccgcauggccaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccgcaaguccacccagaacgccaucgacggcaucaccaacaaggucaacuccgucaucgagaagaugaacacccaguucaccgccgucggcaaggaguucaaccaccucgagaagcgcaucgagaaccucaacaagaaggucgacgacggccuccucgacgucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacgacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccuccucgucucccucggcgccaucuccuucuggaugugcuccaacggcucccuccagugccgcaucugcaucuga

SEQ ID NO: 101604 - RNA, 1701 nt, Artificial Sequence
  derived and/or modified sequence opt2 from hemagglutinin__InfluenzaA__AGN69302
auggaggccaagcucuucguccucuucugcgccuucaccgcccucaaggccgacaccaucugcgucggcuaccacgccaacaacuccaccgacaccgucgacaccauccucgagaagaacgucaccgucacccacuccgucaaccuccucgagaacucccacaacggcaagcucugcucccucaacggcaagaucccccuccagcucggcaacugcaacgucgccggcuggauccucggcaaccccaagugcgaccuccuccucaccgccaacuccugguccuacaucaucgagaccuccaacuccaaggacggcgccugcuaccccggcgaguucgccgacuacgaggagcucaaggagcagcucuccaccgucuccuccuucgagcgcuucgagaucuuccccaaggccaccuccuggcccaaccacgacaccacccgcggcaccaccgucgccugcucccacuccggcgccaacuccuucuaccgcaaccuccucuggaucgucaagaagggcaacuccuaccccaagcucuccaaguccuacaccaacaacaagggcaaggagguccucgucaucuggggcguccaccacccccccaccgacuccgaccagcagacccucuaccagaacaaccacaccuacgucuccgucggcuccuccaaguacuacaagcgcuucacccccgagaucgucgcccgccccaagguccgcgagcaggccggccgcaugaacuacuacuggacccuccucgaccagggcgacaccaucaccuucgaggccaccggcaaccucaucgcccccuggcacgccuucgcccucaagaagggcuccuccuccggcaucaugauguccgacgcccagguccacaacugcaccaccaagugccagaccccccacggcgcccucaagggcaaccuccccuuccagaacguccaccccgucaccaucggcgagugccccaaguacgucaaguccacccagcuccgcauggccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaucgccaucgacggcaucuccaacaaggucaacuccgucaucgagaagaugaacauccaguucaccuccgucggcaaggaguucaacucccucgagaagcgcauggagaaccucaacaagaaggucgacgacggcuuccucgacgucuggaccuacaacgccgagcuccucauccuccucgagaacgagcgcacccucgacuuccacgaccucaacgucaagaaccucuacgagaaggucaagucccagcuccgcaacaacgccaaggagaucggcaacggcugcuucgaguucuaccacaagugcgacaacgagugcauggaguccgucaagaacggcaccuacaacuaccccaaguacuccgaggaguccaagcucaaccgcgaggagaucgacggcgucaagcucgaguccaugggcauccaccagauccucgccaucuacuccaccgucgccuccucccucguccuccucgucucccucggcgccaucuccuucuggaugugcuccaacggcucccuccagugccgcgucugcaucuga

SEQ ID NO: 101605 - RNA, 1701 nt, Artificial Sequence; identical to SEQ ID NO: 101604
  derived and/or modified sequence opt2 from hemagglutinin__InfluenzaA__AGN69314

SEQ ID NO: 101606 - RNA, 1701 nt, Artificial Sequence; identical to SEQ ID NO: 101604
  derived and/or modified sequence opt2 from hemagglutinin__InfluenzaA__AGN69326

SEQ ID NO: 101607 - RNA, 1701 nt, Artificial Sequence
  derived and/or modified sequence opt2 from hemagglutinin__InfluenzaA__AGN69338
auggaggccaagcucuucguccucuucugcgccuucaccgcccucaaggccgacaccaucugcgucggcuaccacgccaacaacuccaccgacaccgucgacaccauccucgagaagaacgucaccgucacccacuccgucaaccuccucgagaacucccacaacggcaagcucugcucccucaacggcaagaucccccuccagcucggcaacugcaacgucgccggcuggauccucggcaaccccaagugcgaccuccuccucaccgccaacuccugguccuacaucaucgagaccuccaacuccaagaacggcgccugcuaccccggcgaguucgccgacuacgaggagcucaaggagcagcucuccaccgucuccuccuucgagcgcuucgagaucuuccccaaggccaccuccuggcccaaccacgacaccacccgcggcaccaccgucgccugcucccacuccggcgccaacuccuucuaccgcaaccuccucuggaucgucaagaagggcaacuccuaccccaagcucuccaaguccuacaccaacaacaagggcaaggagguccucgucaucuggggcguccaccacccccccaccgacuccgaccagcagacccucuaccagaacaaccacaccuacgucuccgucggcuccuccaaguacuacaagcgcuucacccccgagaucgucgcccgccccaagguccgcgagcaggccggccgcaugaacuacuacuggacccuccuccaccagggcgacaccaucaccuucgaggccaccggcaaccucaucgcccccuggcacgccuucgcccucaacgagggcuccuccuccggcaucaugcgcuccgacgcccagguccacaacugcaccaccaagugccagaccccccacggcgcccucaagggcaaccuccccuuccagaacguccaccccgucaccaucggcgagugccccaaguacgucaaguccacccagcuccgcauggccaccggccuccgcaacauccccuccauccagucccgcggccucuucggcgccaucgccggcuucaucgagggcggcuggaccggcauggucgacggcugguacggcuaccaccaccgcaacgagcagggcuccggcuacgccgccgaccagaaguccacccagaucgccaucgacggcaucuccaacaaggucaacuccgucaucgagaagaugaacauccaguucaccuccgucggcaaggagugcaacucccucgagaagcgcauggagaaccucaacaagaaggucgacgacggcuuccucgacgucuggaccuacaacgccgagcuccucauccuccucgagaacgagcgcacccucgacuuccacgaccucaacgucaagaaccucuacgagaaggucaagucccagcuccgcaacaacgccaaggagaucggcaacggcugcuucgaguucuaccacaagugcgacaacgagugcauggaguccgucaagaacggcaccuacaacuaccccaaguacuccgaggaguccaagcucaaccgcgaggagaucgacggcgucaagcucgaguccaugggcauccaccagauccucgccaucuacuccaccgucgccuccucccucguccuccucgucucccucggcgccaucuccuucuggaugugcuccaacggcucccuccagugccgcgucugcaucuga

SEQ ID NO: 101608 - RNA, 1701 nt, Artificial Sequence
  derived and/or modified sequence opt2 from hemagglutinin__InfluenzaA__AGO00265
augaaggcccgccuccucguccuccucugcgccaucgccgccaccgacgccgacaccaucugcaucggcuaccacgccaacaacuccaccgacaccgucgacaccauccucgagaagaacgucaccgucacccacuccgucaaccuccucgaggacucccacaacggcaagcucugccgccucaagggcaucgccccccuccagcucggcaagugcaacaucgccggcuggauccucggcaaccccgagugcgagucccuccucuccgagcgcuccugguccuacaucgucgagacccccaacuccgagaacggcaccugcuaccccggcgacuucaucgacuacgaggagcuccgcgagcagcucuccuccgucaccuccuucgagcgcuucgagaucuuccccaaggagaccuccuggcccaagcacaacaccaccaagggcgucaccgccgccugcucccacgccggcaagugcuccuucuaccgcaaccuccucuggcucaccgagaaggacggcuccuaccccaaccucaacaacuccuacgucaacaagaagggcaaggagguccucguccucuggggcguccaccaccccuccaacaucaaggaccagcagacccucuaccagaaggagaacgccuacgucuccgucgucuccuccaacuacaaccgccgcuucacccccgagaucgccgagcgccccaagguccgcggccaggccggccgcaugaacuacuacuggacccuccucgagcccggcgacaccaucaucuucgaggccaacggcaaccucaucgcccccugguacgccuucgcccucucccgcggcuucggcuccggcaucaucaccuccaacgccuccaugcacgagugcaacaccaagugccagaccccccagggcgccaucaacuccucccuccccuuccagaacauccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaaccucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcuccgcaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 101609 - RNA, 1701 nt, Artificial Sequence
  derived and/or modified sequence opt2 from hemagglutinin__InfluenzaA__AGO00277
augaaggccaagcuccucauccuccucugcgcccucuccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggauccucggcaaccccgagugcgagucccuccucuccaagcgcuccugguccuacaucgccgagacccccaacuccgagaacggcaccugcuaccccggcgacuucgccgacuacgaggagcuccgcgagcagcucuccuccgucuccuccuucgagcgcuucgagaucuuccccaaggagcgcuccuggcccaaccacaacaucaacaucggcgucaccgccgccugcucccacgccggcaaguccuccuucuacaagaaccuccucuggcucaccgagaaggacggcuccuaccccaaccucaacaaguccuacgucaacaagaaggagaaggagguccucguccucuggggcguccaccaccccuccaacaucgagaaccagaagacccucuaccgcaaggagaacgccuacgucuccgucgucuccuccaacuacaaccgccgcuucacccccgagaucgccgagcgccccaagguccgcggccaggccggccgcaugaacuacuacuggacccuccucgagcccggcgacaccaucaucuucgaggccaacggcaaccucaucgcccccugguacgccuucgcccucucccgcggccucggcuccggcaucaucaccuccaacgccuccauggacgagugcgacaccaagugccagaccccccagggcgccaucaacuccucccuccccuuccagaacauccaccccuucaccaucggcgagugccccaaguacguccgcuccaccaagcuccgcauggucaccggccuccgcaacauccccuccauccagucccgcggccucuucggcgccaucgccggcuucaucgagggcggcugggccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcuccgcaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 101610 - RNA, 1701 nt, Artificial Sequence; identical to SEQ ID NO: 93146
  derived and/or modified sequence opt2 from hemagglutinin__InfluenzaA__AGO00289

SEQ ID NO: 101611 - RNA, 1698 nt, Artificial Sequence
  derived and/or modified sequence opt2 from hemagglutinin__InfluenzaA__AGO00301
augaaggccaagcuccucauccuccucugcgcccucuccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaaggccccccuccagcucggcaacugcaacaucgccggcuggguccucggcaaccccgagugcgagucccuccucuccaaccgcuccugguccuacaucgccgagacccccaacuccgagaacggcaccugcuaccccggcgacuucgccgacuacgaggagcuccgcgagcagcucuccuccgucuccuccuucgagcgcuucgagaucuuccccaaggagcgcuccuggcccaaccacaccacccgcggcgucaccgccgccugcccccacgcccgcaaguccuccuucuacaagaaccucgucuggcucaccgaggccaacggcuccuaccccaaccucucccgcuccuacgucaacaaccaggagaaggagguccucguccucuggggcguccaccaccccuccaacaucgaggagcagcgcgcccucuaccgcaaggacaacgccuacgucuccgucgucuccuccaacuacaaccgccgcuucacccccgagaucgccaagcgccccaagguccgcgaccaguccggccgcaugaacuacuacuggacccuccucgagcccggcgacaccaucaucuucgaggccaccggcaaccucaucgcccccugguacgccuucgcccucucccgcggccccggcuccggcaucaucaccuccaacgccccccucgacgagugcgacaccaagugccagaccccccagggcgccaucaacuccucccuccccuuccagaacauccaccccgucaccaucggcgagugccccaaguacguccgcuccaccaagcuccgcauggucaccggccuccgcaacauccccuccguccagucccgcggccucuucggcgccaucgccggcuucaucgagggcggcuggaccggcaugauggacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuucauggacaucuggaccuacaacgccgagcuccucguccuccucgagaacgagcgcacccucgacuuccacgacuccaacgucaagaaccucuacgagaaggucaagaaccagcuccgcaacaacgccaaggagcucggcaacggcugcuucgaguucuaccacaagugcgacaacgagugcauggaguccgucaagaacggcaccuacgacuaccccaaguacuccgaggaguccaagcucaaccgcgagaagaucgacggcgucaagcucgaguccaugggcgucuaccgcauccucgccaucuacuccaccgucgccuccucccucguccuccucgucucccucggcgccaucuccuucuggaugugcuccaacggcucccuccagugccgcaucugcaucuga

SEQ ID NO: 101612 - RNA, 1701 nt, Artificial Sequence
  derived and/or modified sequence opt2 from hemagglutinin__InfluenzaA__AGO00313
augaagaccaucaucgcccucuccuacaucuucugccagguccucgcccagaaccuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccagaacggcggcuccuacgccugcaagcgcggccccgacaacuccuucuucucccgccucaacuggcucuacaaguccgaguccaccuaccccguccucaacgucaccaugcccaacaacgacaacuucgacaagcucuacaucuggggcguccaccaccccuccaccgacaaggagcagaccaaccucuacguccaggccuccggccgcgucaccgucuccaccaagcgcucccagcagaccaucauccccaacgucggcucccgccccuggguccgcggccucuccuccggcaucuccaucuacuggaccaucgucaagcccggcgacauccuccucaucaacuccaacggcaaccucaucgccccccgcggcuacuucaagauccgcaccggcaaguccuccaucaugcgcuccgacgcccccaucggcaccugcuccuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 101613 - RNA, 1704 nt, Artificial Sequence; identical to SEQ ID NO: 100609
  derived and/or modified sequence opt2 from hemagglutinin__InfluenzaA__AGO00325

SEQ ID NO: 101614 - RNA, 1698 nt, Artificial Sequence
  derived and/or modified sequence opt2 from hemagglutinin__InfluenzaA__AGO00337
augaaggccaaccuccucguccuccucuccgcccucgccgccgccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggcuccucggcaaccccgagugcgacccccuccuccccguccgcuccugguccuacaucgucgagacccccaacuccgagaacggcaucugcuaccccggcgacuucaucgacuacgaggagcuccgcgagcagcucuccuccgucuccuccuucgagcgcuucgagaucuuccccaaggaguccuccuggcccaaccacaacaccaacggcgucaccgccgccugcucccacgagggcaaguccuccuucuaccgcaaccuccucuggcucaccgagaaggagggcuccuaccccaagcucaagaacuccuacgucaacaagaagggcaaggagguccucguccucuggggcauccaccacccccccaacuccaaggagcagcagaaccucuaccagaacgagaacgccuacgucuccgucgucaccuccaacuacaaccgccgcuucacccccgagaucgccgagcgccccaagguccgcgaccaggccggccgcaugaacuacuacuggacccuccucaagcccggcgacaccaucaucuucgaggccaacggcaaccucaucgcccccauguacgccuucgcccucucccgcggcuucggcuccggcaucaucaccuccaacgccuccaugcacgagugcaacaccaagugccagaccccccucggcgccaucaacuccucccuccccuaccagaacguccaccccgucaccaucggcgagugccccaaguacguccgcuccgccaagcuccgcauggucaccggccuccgcaacacccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacaccgucaucgagaagaugaacauccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaaggucgacggcgucaagcucgaguccaugggcaucuaccagauccucgccaucuacuccaccgucgccuccucccucguccuccucgucucccucggcgccaucuccuucuggaugugcuccaacggcucccuccagugccgcaucugcaucuga

SEQ ID NO: 101615 - RNA, 1698 nt, Artificial Sequence; identical to SEQ ID NO: 94790
  derived and/or modified sequence opt2 from hemagglutinin__InfluenzaA__AGO00349

SEQ ID NO: 101616 - RNA, 1698 nt, Artificial Sequence
  derived and/or modified sequence opt2 from hemagglutinin__InfluenzaA__AGO00373
augaaggccaaccuccucguccuccucugcgcccucgccgccgccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggcuccucggcaaccccgagugcgacccccuccuccccguccgcuccugguccuacaucgucgagacccccaacuccgagaacggcaucugcuaccccggcgacuucaucgacuacgaggagcuccgcgagcagcucuccuccgucuccuccuucgagcgcuucgagaucuuccccaaggaguccuccuggcccgaccacaacaccaacggcgucaccgccgccugcucccacgagggcaaguccuccuucuaccgcaaccuccucuggcucaccgagaaggaguccuccuaccccaagcucaagaacuccuacgucaacaagaagggcaaggagguccucguccucuggggcauccaccacccccccaacuccaaggagcagcagaaccucuaccagaacgagaacgccuacgucuccgucgucaccuccaacuacaaccgccgcuucacccccgagaucgccgagcgccccaagguccgcgaccaggccggccgcaugaacuacuacuggacccuccucaagcccggcgacaccaucaucuucgaggccaacggcaaccucaucgcccccauguacgccuucgcccucucccgcggcuucggcuccggcaucaucaccuccaacgccuccaugcacgagugcaacaccaagugccagaccccccucggcgccaucaacuccucccuccccuaccagaacauccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacaccgucaucgagaagaugaacauccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacaugaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaaggucgacggcgucaagcucgaguccaugggcaucuaccagauccucgccaucuacuccaccgucgccuccucccucguccuccucgucucccucggcgccaucuccuucuggaugugcuccaacggcucccuccagugccgcaucugcaucuga

SEQ ID NO: 101617 - RNA, 1698 nt, Artificial Sequence
  derived and/or modified sequence opt2 from hemagglutinin__InfluenzaA__AGO00385
augaaggccaaccuccucguccuccucugcgcccucgccgccgccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggcuccucggcaaccccgagugcgacccccuccuccccgucggcuccugguccuacaucgucgagacccccaacuccgagaacggcaucugcuaccccggcgacuucaucgacuacgaggagcuccgcgagcagcucuccuccgucuccuccuucgagcgcuucgagaucuuccccaaggaguccuccuggcccgaccacaacaccaacggcgucaccgccgccugcucccacgagggcaaguccuccuucuaccgcaaccuccucuggcucaccgagaaggaguccuccuaccccaagcucaagaacuccuacgucaacaagaagggcaaggagguccucguccucuggggcauccaccacccccccaacuccaaggagcagcagaaccucuaccagaacgagaacgccuacgucuccgucgucaccuccaacuacaaccgccgcuucacccccgagaucgccgagcgccccaagguccgcgaccaggccggccgcaugaacuacuacuggacccuccucaagcccggcgacaccaucaucuucgaggccaacggcaaccucaucgcccccauguacgccuucgcccucucccgcggcuucggcuccggcaucaucaccuccaacgccuccaugcacgagugcaacaccaagugccagaccccccucggcgccaucaacuccucccuccccuaccagaacauccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacaccgucaucgagaagaugaacauccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaaggucgacggcgucaagcucgaguccaugggcaucuaccagauccucgccaucuacuccaccgucgccuccucccucguccuccucgucucccucggcgccaucuccuucuggaugugcuccaacggcucccuccagugccgcaucugcaucuga

SEQ ID NO: 101618 - RNA, 1698 nt, Artificial Sequence
  derived and/or modified sequence opt2 from hemagglutinin__InfluenzaA__AGO00397
augaaggccaaccuccucguccuccucugcgcccucgccgccgccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggcuccucggcaaccccgagugcgacccccuccuccccgucggcuccugguccuacaucgucgagacccccaacuccgagaacggcaucugcuaccccggcgacuucaucgacuacgaggagcuccgcgagcagcucuccuccgucuccuccuucgagcgcuucgagaucuuccccaaggaguccuccuggcccgaccacaacaccaacggcgucaccgccgccugcucccacgagggcaaguccuccuucuaccgcaaccuccucuggcucaccgagaaggaguccuccuaccccaagcucaagaacuccuacgucaacaagaagggcaaggagguccucguccucuggggcauccaccacccccccaacuccaaggagcagcagaaccucuaccagaacgagaacgccuacgucuccgucgucaccuccaacuacaaccgccgcuucacccccgagaucgccgagcgccccaaggucaaggaccaggccggccgcaugaacuacuacuggacccuccucaagcccggcgacaccaucaucuucgaggccaacggcaaccucaucgcccccauguacgccuucgcccucucccgcggcuucggcuccggcaucaucaccuccaacgccuccaugcacgagugcaacaccaagugccagaccccccucggcgccaucaacuccucccuccccuaccagaacauccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacaccgucaucgagaagaugaacauccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaaggucgacggcgucaagcucgaguccaugggcaucuaccagauccucgccaucuacuccaccgucgccuccucccucguccuccucgucucccucggcgccaucuccuucuggaugugcuccaacggcucccuccagugccgcaucugcaucuga

SEQ ID NO: 101619 - RNA, 1698 nt, Artificial Sequence
  derived and/or modified sequence opt2 from hemagglutinin__InfluenzaA__AGO00409
augaaggccaaccuccucguccuccucugcgcccucgccgccgccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggcuccucggcaaccccgagugcgacccccuccuccccgucggcuccugguccuacaucgucgagacccccaacuccgagaacggcaucugcuaccccggcgacuucaucgacuacgaggagcuccgcgagcagcucuccuccgucuccuccuucgagcgcuucgagaucuuccccaaggaguccuccuggcccgaccacaacaccaacggcgucaccgccgccugcucccacgagggcaagaacuccuucuaccgcaaccuccucuggcucaccgagaagaaguccuccuaccccgagcucaagaacuccuacgucaacaagaagggcaaggagguccucguccucuggggcauccaccacccccccaacuccaaggagcagcagaaccucuaccagaacgagaacgccuacgucuccgucgucaccuccaacuacaaccgccgcuucacccccgagaucgccgagcgccccaaggucaaggaccaggccggccgcaugaacuacuacuggacccuccucaagcccggcgacaccaucaucuucgaggccaacggcaaccucaucgcccccauguacgccuucgcccucucccgcggcuucggcuccggcaucaucaccuccaacgccuccaugcacgagugcaacaccaagugccagaccccccucggcgccaucaacuccucccuccccuaccagaacauccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacaccgucaucgagaagaugaacauccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaaggucgacggcgucaagcucgaguccaugggcaucuaccagauccucgccaucuacuccaccgucgccuccucccucguccuccucgucucccucggcgccaucuccuucuggaugugcuccaacggcucccuccagugccgcaucugcaucuga

SEQ ID NO: 101620 - RNA, 1698 nt, Artificial Sequence
  derived and/or modified sequence opt2 from hemagglutinin__InfluenzaA__AGO00421
augaaggccaaccuccucguccuccucugcgcccucgccgccgccgacgccgacaccaucugcaucggcuaccacgccaacaacuccaccgacaccgucgacaccguccucgagaagaacgucaccgucacccacuccgucaaccuccucgaggacucccacaacggcaagcucugcaagcucaagggcaucgccccccuccagcucggcaagugcaacaucgccggcuggcuccucggcaaccccggcugcgacccccuccuccccgucggcuccugguccuacaucgucgagacccccaacuccgagaacggcaucugcuaccccggcgacuucaucgacuacgaggagcuccgcgagcagcucuccuccgucuccuccuucgagcgcuucaagaucuuccccaaggaguccuccuggcccgaccacaacaccaccggcgucaccgccgccugcucccacgagggcaagaacuccuucuaccgcaaccuccucuggcucaccaagaaggaguccuccuaccccgagcucaagaacuccuacgucaacaagaagcgcaaggagguccucguccucuggggcauccaccacccccccaacuccaaggagcagcagaaccucuaccagaacgagaacgccuacgucuccgucgucaccuccaacuacaaccgccgcuucacccccgagaucgccgagcgccccaaggucaagggccaggccggccgcaugaacuacuacuggacccuccucaagcccggcgacaccaucaucuucgaggccaacggcaaccucaucgcccccauguacgccuucgcccucucccgcggcuucggcuccggcaucaucaccuccaacgccuccaugcacgagugcaacaccaagugccagaccccccucggcgccaucaacuccucccuccccuaccagaacauccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacaccgucaucgagaagaugaacauccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaaggucgacggcgucaagcucgaguccaugggcaucuaccagauccucgccaucuacuccaccgucgccuccucccucguccuccucgucucccucggcgccaucuccuucuggaugugcuccaacggcucccuccagugccgcaucugcaucuga

SEQ ID NO: 101621 - RNA, 1698 nt, Artificial Sequence
  derived and/or modified sequence opt2 from hemagglutinin__InfluenzaA__AGO00433
augaaggccaaccuccucguccuccucugcgcccucgccgccgccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggcuccucggcaaccccgagugcgacccccuccuccccguccgcuccugguccuacaucgucgagacccccaacuccgagaacggcaucugcuaccccggcgacuucaucgacuacgaggagcuccgcgagcagcucuccuccgucuccuccuucgagcgcuucgagaucuuccccaaggaguccuccuggcccaaccacaacaccaacggcgucaccgccgccugcucccacgagggcaaguccuccuucuaccgcaaccuccucuggcucaccgagaaggagggcuccuaccccaagcucgagaacuccuacgucaacaagaagggcaaggagguccucguccucuggggcauccaccacccccccaacuccaaggagcagcagaaccucuaccagaacgagaacgccuacgucuccgucgucaccuccaacuacaaccgccgcuucacccccgagaucgccgagcgccccaagguccgcgaccaggccggccgcaugaacuacuacuggacccuccucaagcccggcgacaccaucaucuucgaggccaacggcaaccucaucgcccccauguacgccuucgcccucucccgcggcuucggcuccggcaucaucaccuccaacgccuccaugcacgagugcaacaccaagugccagaccccccucggcgccaucaacuccucccuccccuaccagaacauccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacaccgucaucgagaagaugaacauccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaaggucgacggcgucaagcucgaguccaugggcaucuaccagauccucgccaucuacuccaccgucgccuccucccucguccuccucgucucccucggcgccaucuccuucuggaugugcuccaacggcucccuccagugccgcaucugcaucuga

SEQ ID NO: 101622 - RNA, 1698 nt, Artificial Sequence
  derived and/or modified sequence opt2 from hemagglutinin__InfluenzaA__AGO00445
augaaggccaaccuccucguccuccucugcgcccucgccgccgccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggcuccucggcaaccccgagugcgacccccuccuccccguccgcuccugguccuacaucgucgagacccccaacuccgagaacggcaucugcuaccccggcgacuucaucgacuacgaggagcuccgcgagcagcucuccuccgucuccuccuucgagcgcuucgagaucuuccccaaggaguccuccuggcccaaccacaacaccaacggcgucaccgccgccugcucccacgagggcaaguccuccuucuaccgcaaccuccucuggcucaccgagaaggagggcuccuaccccacccucaagaacuccuacgucaacaagaagggcaaggagguccucguccucuggggcauccaccacccccccaacuccaaggagcagcagaaccucuaccagaacgagaacgccuacgucuccgucgucaccuccaacuacaaccgccgcuucacccccgagaucgccgagcgccccaagguccgcgaccaggccggccgcaugaacuacuacuggacccuccucaagcccggcgacaccaucaucuucgaggccaacggcaaccucaucgcccccauguacgccuucgcccucucccgcggcuucggcuccggcaucaucaccuccaacgccuccaugcacgagugcaacaccaagugccagaccccccucggcgccaucaacuccucccuccccuaccagaacauccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacaccgucaucgagaagaugaacauccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaaggucgacggcgucaagcucgaguccaugggcaucuaccagauccucgccaucuacuccaccgucgccuccucccucguccuccucgucucccucggcgccaucuccuucuggaugugcuccaacggcucccuccagugccgcaucugcaucuga

SEQ ID NO: 101623 - RNA, 1701 nt, Artificial Sequence
  derived and/or modified sequence opt2 from hemagglutinin__InfluenzaA__AGO02696
augaaggccauccucgucgucaugcucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaucuccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 101624 - RNA, 1701 nt, Artificial Sequence; identical to SEQ ID NO: 101552
  derived and/or modified sequence opt2 from hemagglutinin__InfluenzaA__AGO02697

SEQ ID NO: 101625 - RNA, 1701 nt, Artificial Sequence; identical to SEQ ID NO: 101370
  derived and/or modified sequence opt2 from hemagglutinin__InfluenzaA__AGO02698

SEQ ID NO: 101626 - RNA, 1701 nt, Artificial Sequence; identical to SEQ ID NO: 101370
  derived and/or modified sequence opt2 from hemagglutinin__InfluenzaA__AGO02699

SEQ ID NO: 101627 - RNA, 1701 nt, Artificial Sequence
  derived and/or modified sequence opt2 from hemagglutinin__InfluenzaA__AGO02700
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccaggccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccguccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgcccagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuacccccgcuacuccgaggaggccaagcucaaccgcgaggagaucgacggcaucaagcucgaguccacccgcaucuaccagauccucgccaucuacuccaccgucgccuccucccucguccucaucgucucccucggcgccaucuccuucuggaugugcuccaacggcucccuccagugccgcaucugcaucuga

SEQ ID NO: 101628 - RNA, 1701 nt, Artificial Sequence
  derived and/or modified sequence opt2 from hemagglutinin__InfluenzaA__AGO02701
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucucccacuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccguccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacggccagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101629 - RNA, 1683 nt, Artificial Sequence; identical to SEQ ID NO: 101500
  derived and/or modified sequence opt2 from hemagglutinin__InfluenzaA__AGO51374

SEQ ID NO: 101630 - RNA, 1701 nt, Artificial Sequence
  derived and/or modified sequence opt2 from hemagglutinin__InfluenzaA__AGO86686
augaagaccaucaucgcccucuccuacauccucugccucgccuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucgagaaccgcuaccccgcccucaacgucaccaugcccaacaacgacaaguucgacaagcucuacaucuggggcguccaccaccccuccaccgacuccgaccagaucuccgucuacgcccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaacaagcucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaccuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 101631 - RNA, 1701 nt, Artificial Sequence; identical to SEQ ID NO: 101552
  derived and/or modified sequence opt2 from hemagglutinin__InfluenzaA__AGQ16240

SEQ ID NO: 101632 - RNA, 1701 nt, Artificial Sequence; identical to SEQ ID NO: 101552
  derived and/or modified sequence opt2 from hemagglutinin__InfluenzaA__AGQ16241

SEQ ID NO: 101633 - RNA, 1701 nt, Artificial Sequence
  derived and/or modified sequence opt2 from hemagglutinin__InfluenzaA__AGQ16242
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaccuccuacaucaacgacaagggcaaggagauccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101634 - RNA, 1701 nt, Artificial Sequence; identical to SEQ ID NO: 101572
  derived and/or modified sequence opt2 from hemagglutinin__InfluenzaA__AGQ16243

SEQ ID NO: 101635 - RNA, 1701 nt, Artificial Sequence
  derived and/or modified sequence opt2 from hemagglutinin__InfluenzaA__AGQ16245
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucaucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101636 - RNA, 1701 nt, Artificial Sequence; identical to SEQ ID NO: 101572
  derived and/or modified sequence opt2 from hemagglutinin__InfluenzaA__AGQ16247

SEQ ID NO: 101637 - RNA, 1701 nt, Artificial Sequence
  derived and/or modified sequence opt2 from hemagglutinin__InfluenzaA__AGQ16248
augcaggccauccucgucguccuccucuacaccuucgccaccgccaccgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccauccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101638 - RNA, 1701 nt, Artificial Sequence; identical to SEQ ID NO: 101370
  derived and/or modified sequence opt2 from hemagglutinin__InfluenzaA__AGQ16329

SEQ ID NO: 101639 - RNA, 1701 nt, Artificial Sequence; identical to SEQ ID NO: 101395
  derived and/or modified sequence opt2 from hemagglutinin__InfluenzaA__AGQ16331

SEQ ID NO: 101640 - RNA, 1701 nt, Artificial Sequence; identical to SEQ ID NO: 101370
  derived and/or modified sequence opt2 from hemagglutinin__InfluenzaA__AGQ16332

SEQ ID NO: 101641 - RNA, 1701 nt, Artificial Sequence; identical to SEQ ID NO: 101370
  derived and/or modified sequence opt2 from hemagglutinin__InfluenzaA__AGQ16333

SEQ ID NO: 101642 - RNA, 1701 nt, Artificial Sequence
  derived and/or modified sequence opt2 from hemagglutinin__InfluenzaA__AGQ16335
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagguccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101643 - RNA, 1701 nt, Artificial Sequence
  derived and/or modified sequence opt2 from hemagglutinin__InfluenzaA__AGQ16336
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaaccgcuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101644 - RNA, 1701 nt, Artificial Sequence; identical to SEQ ID NO: 101642
  derived and/or modified sequence opt2 from hemagglutinin__InfluenzaA__AGQ16337

SEQ ID NO: 101645 - RNA, 1701 nt, Artificial Sequence; identical to SEQ ID NO: 101380
  derived and/or modified sequence opt2 from hemagglutinin__InfluenzaA__AGQ16338

SEQ ID NO: 101646 - RNA, 1701 nt, Artificial Sequence
  derived and/or modified sequence opt2 from hemagglutinin__InfluenzaA__AGQ16339
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaagaacuggauccucuggaucuccuucgccaucuccugcuuccuccucugcgucgcccuccucggcuucaucaugugggccugccagaagggcaacauccgcugcaacaucugcaucuga

SEQ ID NO: 101647 - RNA, 1701 nt, Artificial Sequence; identical to SEQ ID NO: 101506
  derived and/or modified sequence opt2 from hemagglutinin__InfluenzaA__AGQ16340

SEQ ID NO: 101648 - RNA, 1701 nt, Artificial Sequence; identical to SEQ ID NO: 101370
  derived and/or modified sequence opt2 from hemagglutinin__InfluenzaA__AGQ16341

SEQ ID NO: 101649 - RNA, 1701 nt, Artificial Sequence; identical to SEQ ID NO: 101380
  derived and/or modified sequence opt2 from hemagglutinin__InfluenzaA__AGQ16342

SEQ ID NO: 101650 - RNA, 1701 nt, Artificial Sequence
  derived and/or modified sequence opt2 from hemagglutinin__InfluenzaA__AGQ16343
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101651 - RNA, 1701 nt, Artificial Sequence; identical to SEQ ID NO: 101380
  derived and/or modified sequence opt2 from hemagglutinin__InfluenzaA__AGQ16344

SEQ ID NO: 101652 - RNA, 1701 nt, Artificial Sequence; identical to SEQ ID NO: 101370
  derived and/or modified sequence opt2 from hemagglutinin__InfluenzaA__AGQ16345

SEQ ID NO: 101653 - RNA, 1701 nt, Artificial Sequence
  derived and/or modified sequence opt2 from hemagglutinin__InfluenzaA__AGQ16346
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugccgcuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101654 - RNA, 1701 nt, Artificial Sequence; identical to SEQ ID NO: 101370
  derived and/or modified sequence opt2 from hemagglutinin__InfluenzaA__AGQ16347

SEQ ID NO: 101655 - RNA, 1701 nt, Artificial Sequence; identical to SEQ ID NO: 101506
  derived and/or modified sequence opt2 from hemagglutinin__InfluenzaA__AGQ16348

SEQ ID NO: 101656 - RNA, 1701 nt, Artificial Sequence; identical to SEQ ID NO: 101370
  derived and/or modified sequence opt2 from hemagglutinin__InfluenzaA__AGQ16349

SEQ ID NO: 101657 - RNA, 1701 nt, Artificial Sequence
  derived and/or modified sequence opt2 from hemagglutinin__InfluenzaA__AGQ16350
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucauguggaccugccagaagggcaacauccgcugcaacaucugcaucuga

SEQ ID NO: 101658 - RNA, 1701 nt, Artificial Sequence
  derived and/or modified sequence opt2 from hemagglutinin__InfluenzaA__AGQ47719
augaaggccauccuccucguccuccucugcaccuucaccgccaccaacgccgacacccucugcaucggcuaccacgccaacaacuccaccgacaccgucgacaccguccucgagaagaacgucaccgucacccacuccgucaaccuccucgaggaccgccacaacggcaagcucugcaagcucggcggcaucgccccccuccaccucggcaagugcaacaucgccggcuggcuccucggcaaccccgagugcgagcuccucuucaccgucuccuccugguccuacaucgucgagaccuccaacuccgacaacggcaccugcuaccccggcgacuucaucaacuacgaggagcuccgcgagcagcucuccuccgucuccuccuucgagcgcuucgagaucuuccccaagaccuccuccuggcccgaccacgagaccaaccgcggcgucaccgccgccugccccuacgccggcgccaacuccuucuaccgcaaccucaucuggcucgucaagaagggcaacuccuaccccaagcucuccaaguccuacgucaacaacaagggcaaggagguccucguccucuggggcauccaccacccccccaccuccaccgaccagcagucccucuaccagaacgccgacgccuacgucuucgucggcuccuccaaguacaaccgcaaguucaagcccgagaucgccgcccgccccaagguccgcggccaggccggccgcaugaacuacuacuggacccucaucgagcccggcgacaccaucaccuucgaggccaccggcaaccucgucgucccccgcuacgccuucgccaugaaccgcggcuccggcuccggcaucaucaucuccgacgcccccauccacgacugcaacaccaagugccagacccccaagggcgccaucaacaccucccuccccuuccagaacauccaccccgucaccaucggcgagugccccaaguacgucaaguccaccaagcuccgcauggccaccggccuccgcaacauccccuccauccagucccgcggccucuucggcgccaucgccggcuucaucgagggcggcuggaccggcaugaucgacggcugguacggcuaccaccaccagaacggccagggcuccggcuacgccgccgaccagaaguccacccagaacgccaucgacggcaucaccaacaaggucaacuccgucaucgagaagaugaacacccaguucaccgccgucggcaaggaguucaaccaccucgagaagcgcaucgagaaccucaacaagaaggucgacgacggcuuccucgacgucuggaccuacaacgccgagcuccucguccuccucgagaacgagcgcacccucgacuuccacgacuccaacgucaagaaccucuacgagaagguccgcucccagcuccgcaacaacgccaaggagaucggcaacggcugcuucgaguucuaccacaagugcgacgacaccugcauggaguccgucaagaacggcaccuacgacuaccccaaguacuccgaggaguccaagcucaaccgcgaggagaucgacggcgucaagcucgaguccacccgcaucuaccagauccucgccaucuacuccaccgccgccuccucccucguccuccucgucucccucggcgccaucuccuucuggaugugcuccaacggcucccuccagugccgcaucugcaucuga

SEQ ID NO: 101659 - RNA, 1698 nt, Artificial Sequence; identical to SEQ ID NO: 93627
  derived and/or modified sequence opt2 from hemagglutinin__InfluenzaA__AGQ47728

SEQ ID NO: 101660 - RNA, 1701 nt, Artificial Sequence
  derived and/or modified sequence opt2 from hemagglutinin__InfluenzaA__AGQ47740
augaaggcccgccuccucguccuccucugcgcccucgccgccaccgacgccgacaccaucugcaucggcuaccacgccaacaacuccaccgacaccgucgacacccuccucgagaagaacgucaccgucacccacuccgucaaccuccucgaggacucccacaacggcaagcucugcaagcucaagggcaucgccccccuccagcucggcaagugcaacaucgccggcuggcuccucggcaaccccgagugcgacucccuccuccccgcccgcuccugguccuacaucgucgagacccccaacuccgagaacggcgccugcuaccccggcgacuucaucgacuacgaggagcuccgcgagcagcucuccuccgucuccucccucgagcgcuucgagaucuuccccaaggaguccuccuggcccaaccacaacaccaucaagggcgucaccgccuccugcucccaccgcggccaguccuccuucuaccgcaaccuccucuggcucaccaagaagggcgacuccuaccccaagcucaacaacuccuacgucaacaacaagggcaaggagguccucguccucuggggcguccaccaccccuccuccuccaacgagcagcagucccucuaccgcaacgagaacgccuacgucuccgucgucuccuccaacuacaaccgccgcuucacccccgagaucgccgcccgccccaagguccgcgaccagaccggccgcaugaacuacuacuggacccuccucgagcccggcgacaccaucauguucgaggccaccggcaaccucaucgcccccugguacgccuucgcccucucccgcggcuucggcuccggcaucaucaccuccaacgccuccaugcacgagugcaacaccaagugccagaccccccagggcgccaucaacuccucccuccccuuccagaacauccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaaccucgagaagcgcauggagaaccucaacaagaaggucgacgacggcuuccucgacaucuggaccuacaacgccgagcuccucguccuccucgagaacgagcgcacccucgacuuccacgaccucaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 101661 - RNA, 1701 nt, Artificial Sequence
  derived and/or modified sequence opt2 from hemagglutinin__InfluenzaA__AGQ47752
augaaggccaagcuccucauccuccucugcgcccucuccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaaggccccccuccagcucggcaagugcaacaucgccggcuggguccucggcaaccccgagugcgagucccuccucuccaaccgcuccugguccuacaucgccgagacccccaacuccgagaacggcaucugcuaccccggcgacuucgccgacuacgaggagcuccgcgagcagcucuccuccgucuccuccuucgagcgcuucgagaucuuccccaaggagcgcuccuggcccaagcacaacaccauccgcggcgucaccgccgccugcucccacgccggcaaguccuccuucuacaagaaccucgucuggcucaccgaggccaacggcuccuaccccgcccucuccaccuccuacgucaacaaccaggagaaggagguccucguccucuggggcguccaccaccccuccaacaucgaggagcagcgcacccucuaccgcaaggacaacgccuacgucuccgucgucuccuccaacuacaaccgccgcuucacccccgagaucgccaagcgccccaagguccgcgaccagcccggccgcaugaacuacuacuggacccuccucgagcccggcgacaccaucaucuucgaggccaccggcaaccucaucgcccccugguacgccuucgcccucucccgcggccccggcuccggcaucaucaccuccaacgcccccauggacgagugcgacaccaagugccagaccccccagggcgccaucaacuccucccuccccuuccagaacauccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugauggacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcuccgcaacaacgccaaggagcucggcaacggcugcuucgaguucuaccacaagugcgacaacgagugcauggaguccgucaagaacggcaccuacgacuaccccaaguacuccgaggaguccaagcucaaccgcgagaagaucgacggcgucaagcucgaguccaugggcgucuaccgcauccucgccaucuacuccaccgucgccuccucccucguccuccucgucucccucggcgccaucuccuucuggaugugcuccaacggcucccuccagugccgcaucugcaucuga

SEQ ID NO: 101662 - RNA, 1701 nt, Artificial Sequence
  derived and/or modified sequence opt2 from hemagglutinin__InfluenzaA__AGQ47764
augaaggccaagcuccucauccuccucugcgcccucaccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggauccucggcaaccccgagugcgagucccuccucuccaagcgcuccugguccuacaucgccgagacccccaacuccgagaacggcgccugcuaccccggcgacuucgccgacuacgaggagcuccgcgagcagcucuccuccgucuccuccuucgagcgcuucgagaucuuccccaaggagcgcuccuggcccaagcacaacaucacccgcggcgucaccgccgccugcucccacgccggcaaguccuccuucuacaagaaccuccucuggcucaccgagaccgacggcuccuaccccaagcucuccaaguccuacgucaacaacaaggagaaggagguccucguccucuggggcguccaccaccccuccaacaucgaggaccagaagacccucuaccgcaaggagaacgccuacgucuccgucgucuccuccaacuacaaccgccgcuucacccccgagaucgccgagcgccccaagguccgcggccaggccggccgcaucaacuacuacuggacccuccucgagcccggcgacaccaucaucuucgaggccaacggcaaccucaucgcccccugguacgccuucgcccucucccgcgacuucggcuccggcaucaucaccuccaacgccuccauggacgagugcgacaccaagugccagaccccccagggcgccaucaacuccucccuccccuuccagaacauccaccccgucaccaucggcgagugccccaaguacgucaaguccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcuccgcaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 101663 - RNA, 1701 nt, Artificial Sequence
  derived and/or modified sequence opt2 from hemagglutinin__InfluenzaA__AGQ47776
augaaggccaagcuccucauccuccucugcgcccucuccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggauccucggcaaccccgagugcgagucccuccucuccaagcgcuccugguccuacaucgccgagacccccaacuccgagaacggcaccugcuaccccggcgacuucgccgacuacgaggagcuccgcgagcagcucuccuccgucuccuccuucgagcgcuucgagaucuuccccaaggagcgcuccuggcccaagcacaacaucaacaucggcgucaccgccgccugcucccacgccggcaaguccuccuucuacaagaaccuccucuggcucaccgagaaggacggcuccuaccccaaccucaacaaguccuacgucaacaagaaggagaaggagguccucguccucuggggcguccaccaccccuccaacaucgaggaccagaagacccucuaccgcaaggagaacgccuacgucuccgucgucuccuccaacuacaaccgccgcuucacccccgagaucgccgagcgccccaagguccgcggccaggccggccgcaugaacuacuacuggacccuccucgagcccggcgacaccaucaucuucgaggccaacggcaaccucaucgcccccugguacgccuucgcccucucccgcggccucggcuccggcaucaucaccuccaacgccuccauggacgagugcgacaccaagugccagaccccccagggcgccaucaacuccucccuccccuuccagaacauccaccccuucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagaaccagcuccgcaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 101664 - RNA, 1701 nt, Artificial Sequence
  derived and/or modified sequence opt2 from hemagglutinin__InfluenzaA__AGQ47788
augaaggccaagcuccucguccuccucugcgcccucuccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggauccucggcaaccccgagugcgagucccucuucuccaagaaguccugguccuacaucgccgagacccccaacuccgagaacggcaccugcuaccccggcuacuucgccgacuacgaggagcuccgcgagcagcucuccuccgucuccuccuucgagcgcuucgagaucuuccccaaggagcgcuccuggcccaagcacaacgucacccgcggcgucaccgccgccugcucccacaagggcaaguccuccuucuaccgcaaccuccucuggcucaccgagaaggacggcuccuaccccaaccucuccaaguccuacgucaacaacaaggagaaggagguccucguccucuggggcguccaccaccccuccaacaucgaggaccagaagacccucuaccgcaaggagaacgccuacgucuccgucgucuccuccaacuacaaccgccgcuucacccccgagaucgccgagcgccccaagguccgcggccaggccggccgcaucaacuacuacuggacccuccucgagcccggcgacaccaucaucuucgaggccaacggcaaccucaucgcccccuggcacgccuucgcccucucccgcggcuucggcuccggcaucaucaccuccaacgccuccauggacgagugcgacaccaagugccagaccccccagggcgccaucaacuccucccuccccuuccagaacauccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 101665 - RNA, 1701 nt, Artificial Sequence
  derived and/or modified sequence opt2 from hemagglutinin__InfluenzaA__AGQ47800
augaaggcccgccuccucguccuccucugcgcccucgccgccaccgacgccgacaccaucugcaucggcuaccacgccaacaacuccaccgacaccgucgacaccauccucgagaagaacgucaccgucacccacuccgucaaccuccucgaggacucccacaacggcaagcucugccgccucaagggcaucgccccccuccagcucggcaagugcaacaucgccggcuggauccucggcaaccccgagugcgagucccuccucuccgagcgcuccugguccuacaucgucgagauccccaacuccgagaacggcaccugcuaccccggcgacuucaccgacuacgaggagcuccgcgagcagcucuccuccgucuccuccuucgagcgcuucgagaucuuccccaaggaguccuccuggcccaagcacaacaccgcccgcggcgucaccgccgccugcucccacgccggcaaguccuccuucuaccgcaaccuccucuggcucaccgagaaggacggcuccuaccccaaccucaagaacuccuacgucaacaagaagggcaaggagguccucguccucuggggcguccaccaccccuccuccaucaaggagcagcagacccucuaccagaaggagaacgccuacgucuccgucgucuccuccaacuacaaccgccgcuucacccccgagaucgccgagcgccccaagguccgcgaccaggccggccgcaugaacuacuacuggacccuccucgagcccggcgacaccaucaucuucgaggccaacggcaaccucaucgcccccugguacgccuucgcccucucccgcggcuucggcuccggcaucaucaccuccaacgccuccaugcacgagugcgacaccaagugccagaccccccagggcgccaucaacuccucccuccccuuccagaacauccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaaccucgagaagcgcauggagaaccucaacaagaaggucgacgacggcuuccucgacaucuggaccuacaacgccgagcuccucauccuccucgagaacgagcgcacccucgacuuccacgacuccaacgucaagaaccucuacgagaaggucaagucccagcuccgcaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 101666 - RNA, 1701 nt, Artificial Sequence
  derived and/or modified sequence opt2 from hemagglutinin__InfluenzaA__AGQ47811
augaaggccaagcuccucguccuccucugcgcccucuccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggauccucggcaaccccgagugcgagucccucuucuccaagaaguccugguccuacaucgccgagacccccaacuccgagaacggcaccugcuaccccggcuucuucgccgacuacgaggagcuccgcgagcagcucuccuccgucuccuccuucgagcgcuucgagaucuuccccaaggagcgcuccuggcccaagcacaacgucacccgcggcgucaccgccgccugcucccacaagggcaaguccuccuucuaccgcaaccuccucuggcucaccgagaagaacggcuccuaccccaaccucuccaaguccuacgucaacaacaaggagaaggagguccucguccucuggggcguccaccaccccuccaacaucgaggaccagaagaccaucuaccgcaaggagaacgccuacgucuccgucgucuccuccaacuacaaccgccgcuucacccccgagaucgccgagcgccccaagguccgcggccaggccggccgcaucaacuacuacuggacccuccucgagcccggcgacaccaucaucuucgaggccaacggcaaccucaucgcccccuggcacgccuucgcccucucccgcggcuucggcuccggcaucaucaccuccaacgccuccauggacgagugcgacaccaagugccagaccccccagggcgccaucaacuccucccuccccuuccagaacauccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucgacggcaucaccaacaaggucaacuccgucaucgagaagaugaacacccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 101667 - RNA, 1701 nt, Artificial Sequence
  derived and/or modified sequence opt2 from hemagglutinin__InfluenzaA__AGQ47823
augaaggccaagcuccucguccuccucugcgccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaacugcuccgucgccggcuggauccucggcaaccccaagugcgagucccucuucuccaaggaguccugguccuacaucgccgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccaagggcgucaccaccuccugcucccacaacggcaaguccuccuucuaccgcaaccuccucuggcucaccgagaagaacggccucuaccccaaccucuccaaguccuacgucaacaacaaggagaaggagguccucguccucuggggcguccaccaccccuccaacauccgcgaccagcgcgccaucuaccacaccgagaacgccuacgucuccgucgucuccucccacuacucccgccgcuucacccccgagaucgccaagcgccccaagguccgcggccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgccuccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacggccgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcggcaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 101668 - RNA, 1701 nt, Artificial Sequence
  derived and/or modified sequence opt2 from hemagglutinin__InfluenzaA__AGQ47835
augaagaccaucaucgcccucuccuacaucuucugccucguccucggccaggacuuccccggcaacgacaacuccaccgccacccucugccucggccaccacgccguccccaacggcaccaucgucaagaccaucaccaacgaccagaucgaggucaccaacgccaccgagcucguccaguccuccuccaccggcaagaucugcaacaacccccaccgcauccucgacggcaucaacugcacccucaucgacgcccuccucggcgacccccacugcgacggcuuccagaacgagaccugggaccucuucgucgagcgcuccaaggccuucuccaacugcuaccccuacuacguccccgacuacgccucccuccgcucccucgucgccuccuccggcacccucgaguucaucaacgagggcuucaacuggaccggcgucacccagaacggcggcuccaacgccugcaagcgcggccccaacuccggcuucuucucccgccucaacuggcucuacaaguccggcaccaccuaccccguccucaacgucaccaugcccaacaacgacaacuucgacaagcucuacaucuggggcguccaccaccccuccaccgaccaggagcagaccaaccucuacguccaggccuccggccgcgucaccgucuccaccaagcgcucccagcagaccaucacccccaacaucggcucccgccccuggguccgcggccucuccucccgcaucuccaucuacuggaccaucgucaagcccggcgacauccucgucaucaacuccaacggcaaccucaucgccccccgcggcuacuucaagaugcgcaccggcaaguccuccaucaugcgcuccgacgcccccaucggcaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 101669 - RNA, 1701 nt, Artificial Sequence
  derived and/or modified sequence opt2 from hemagglutinin__InfluenzaA__AGQ47847
augaaggcccgccuccucauccuccucugcgcccucgccgccaccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggcuccucggcaaccccgagugcgacucccuccuccccgccuccuccugguccuacaucgucgagacccccaacuccaagaacggcaucugcuaccccggcgacuucaucgacuacgaggagcuccgcgagcagcucuccuccgucuccuccuucgagcgcuucgagaucuuccccaaggaguccuccuggcccaagcacaacaccaccaagggcgucaccgccgccugcucccacgccggcaaguccuccuucuaccgcaaccuccucuggcucaccaagaaggaggacuccuaccccaagcucuccaacuccuacgucaacaagaagggcaaggagguccucguccucuggggcguccaccaccccuccaacuccaaggagcagcagacccucuaccagaacgagaacgccuacgucuccgucgucuccuccaacuacaaccgccgcuucacccccgagaucgccgagcgccccaagguccgcgaccaggccggccgcaugaacuacuacuggacccuccucgagcccggcgacaccaucaucuucgaggccaacggcaaccucaucgcccccugguacgccuucgcccucucccgcggcuucggcuccggcaucaucaccuccaacgccuccaugcacgagugcaacaccaagugccagaccccccagggcgccaucaacuccucccuccccuuccagaacauccaccccgucaccaucggcgagugccccaaguacgucaaguccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaaccucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagauccagcucaagaacaacgccaaggagaucggcaacggcugcuucgaguucuaccacaagugcgacaacgagugcauggaguccguccgcaacggcaccuacgacuaccccaaguacuccaaggaguccaagcucaaccgcgagaagaucgacggcgucaagcucgagcccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 101670 - RNA, 1701 nt, Artificial Sequence
  derived and/or modified sequence opt2 from hemagglutinin__InfluenzaA__AGQ47870
augaaggccauccuccucguccuccucugcaccuucgccgccaccaacgccgacacccucugcaucggcuaccacgccaacaacuccaccgacaccgucgacaccguccucgagaagaacgucaccgucacccacuccgucaaccuccucgaggaccgccacaacggcaagcucugcaagcucggcggcaucgccccccuccaccucggcaagugcaacaucgccggcuggcuccucggcaaccccgagugcgagcuccuccucaccgucuccuccugguccuacaucgucgagaccuccaacuccgacaacggcaccugcuaccccggcgacuucaucaacuacgaggagcuccgcgagcagcucuccuccgucuccuccuucgagcgcuucgagaucuuccccaagaccuccuccuggcccaaccacgagaccaaccgcggcgucaccgccgccugccccuacgccggcgccaacuccuucuaccgcaaccucaucuggcucgucaagaagggcaacuccuaccccaagcucuccaaguccuacgucaacaacaagggcaaggagguccucguccucuggggcauccaccacccccccaccuccaccgaccagcagucccucuaccagaacgccgacgccuacgucuucgucggcuccuccaaguacaaccgcaaguucaagcccgagaucgccgcccgccccaagguccgcggccaggccggccgcaugaacuacuacuggacccucaucgagcccggcgacaccaucaccuucgaggccaccggcaaccucgucgucccccgcuacgccuucgccaugaaccgcggcuccggcuccggcaucaucaucuccgacgcccccguccacgacugcaacaccaagugccagacccccaagggcgccaucaacaccucccuccccuuccagaacauccaccccgucaccaucggcgagugccccaaguacgucaaguccaccaagcuccgcauggccaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagcgcuccacccagaacgccaucgacggcaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuuccacgacuccaacgucaagaaccucuacgagaagguccgcucccagcuccgcaacaacgccaaggagaucggcaacggcugcuucgaguucuaccacaagugcgacgacaccugcauggaguccgucaagaacggcaccuacgacuaccccaaguacuccgaggaguccaagcucaaccgcgaggagaucgacggcgucaagcucgaguccacccgcaucuaccagauccucgccaucuacuccaccgucgccuccucccucguccuccucgucucccucggcgccaucuccuucuggaugugcuccaacggcucccuccagugccgcaucugcaucuga

SEQ ID NO: 101671 - RNA, 1701 nt, Artificial Sequence
  derived and/or modified sequence opt2 from hemagglutinin__InfluenzaA__AGQ47882
augaaggccauccuccucguccuccucugcaccuucgccgccaccaacgccgacacccucugcaucggcuaccacgccaacaacuccaccgacaccgucgacaccguccucgagaagaacgucaccgucacccacuccgucaaccuccucgaggaccgccacaacggcaagcucugcaagcucggcggcaucgccccccuccaccucggcaagugcaacaucgccggcuggcuccucggcaaccccgagugcgagcuccuccucaccgucuccuccugguccuacaucgucgagaccuccaacuccgacaacggcaccugcuaccccggcgacuucaucaacuacgaggagcuccgcgagcagcucuccuccgucuccuccuucgagcgcuucgagaucuuccccaagaccuccuccuggcccaaccacgagaccaaccgcggcgucaccgccgccugccccuacgccggcgccaacuccuucuaccgcaaccucaucuggcucgucaagaaggagaacuccuaccccaagcucuccaaguccuacgucaacaacaagggcaaggagguccucguccucuggggcauccaccacccccccaccuccaccgaccagcagucccucuaccagaacgccgacgccuacgucuucgucggcuccuccaaguacaaccgcaaguucaagcccgagaucgccgcccgccccaagguccgcggccaggccggccgcaugaacuacuacuggacccucaucgagcccggcgacaccaucaccuucgaggccaccggcaaccucgucgucccccgcuacgccuucgccaugaaccgcggcuccggcuccggcaucaucaucuccgacgcccccguccacgacugcaacaccaagugccagacccccaagggcgccaucaacaccucccuccccuuccagaacauccaccccgucaccaucggcgagugccccaaguacgucaaguccaccaagcuccgcauggccaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagcgcuccacccagaacgccaucgacggcaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuuccacgacuccaacgucaagaaccucuacgagaagguccgcucccagcuccgcaacaacgccaaggagaucggcaacggcugcuucgaguucuaccacaagugcgacgacaccugcauggaguccgucaagaacggcaccuacgacuaccccaaguacuccgaggaguccaagcucaaccgcgaggagaucgacggcgucaagcucgaguccacccgcaucuaccagauccucgccaucuacuccaccgucgccuccucccucguccuccucgucucccucggcgccaucuccuucuggaugugcuccaacggcucccuccagugccgcaucugcaucuga

SEQ ID NO: 101672 - RNA, 1701 nt, Artificial Sequence; identical to SEQ ID NO: 100607
  derived and/or modified sequence opt2 from hemagglutinin__InfluenzaA__AGQ47894

SEQ ID NO: 101673 - RNA, 1701 nt, Artificial Sequence
  derived and/or modified sequence opt2 from hemagglutinin__InfluenzaA__AGQ47906
augaagaccaucaucgcccucuccuacaucuucugccucgcccucggccaggaccuccccggcaacgacaacuccaccgccacccucugccucggccaccacgccguccccaacggcacccucgucaagaccaucaccgacgaccagaucgaggucaccaacgccaccgagcucguccaguccuccuccaccggcaagaucugcaacaacccccaccgcauccucgacggcaucgacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccccguccucaacgucaccaugcccaacaacgacaacuucgacaagcucuacaucuggggcauccaccaccccuccaccaaccaggagcagaccucccucuacguccaggccuccggccgcgucaccgucuccacccgccgcucccagcagaccaucauccccaacaucggcucccgccccuggguccgcggccucuccucccgcaucuccaucuacuggaccaucgucaagcccggcgacguccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 101674 - RNA, 1701 nt, Artificial Sequence
  derived and/or modified sequence opt2 from hemagglutinin__InfluenzaA__AGQ47918
augaagaccaucaucgcccucuccuacaucuucugccucgcccucggccaggaccuccccggcaacgacaacaacaccgccacccucugccucggccaccacgccguccccaacggcacccucgucaagaccaucaccgacgaccagaucgaggucaccaacgccaccgagcucguccaguccuccuccaccggcaagaucugcaacaacccccaccgcauccucgacggcaucgacugcacccucaucgacgcccuccucggcgacccccacugcgacgucuuccagaacgagaccugggaccucuucgucgagcgcuccaaggccuucuccaacugcuaccccuacgacguccccgacuacgccucccuccgcucccucgucgccuccuccggcacccucgaguucaucaccgagggcuucaccuggaccggcgucacccagaacggcggcuccaacgccugcaagcgcggccccggcuccggcuucuucucccgccucaacuggcucaccaaguccggcuccaccuaccccguccucaacgucaccaugcccaacaacgacaacuucgacaagcucuacaucuggggcguccaccaccccuccaccaaccaggagcagaccucccucuacguccaggccuccggccgcgucaccgucuccacccgccgcucccagcagaccaucauccccaacaucggcucccgccccuggguccgcggccucuccucccgcaucuccaucuacuggaccaucgucaagcccggcgacguccucgucaucaacuccaacggcaaccucaucgccccccgcggcuacuucaagaugcgcaccggcaaguccuccaucaugcgcuccgacgcccccaucgacaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 101675 - RNA, 1701 nt, Artificial Sequence
  derived and/or modified sequence opt2 from hemagglutinin__InfluenzaA__AGQ47930
augaaggccaaccuccucguccuccucugcgcccucgccgccgccgacgccgacaccaucugcaucggcuaccacgccaacaacuccaccgacaccgucgacaccgcccucgagaagaacgucaccgucacccacuccgucaaccuccucgaggacucccacaacggcaagcucugccgccucaagggcaucgccccccuccagcucggcaagugcaacaucgccggcuggcuccucggcaaccccgagugcgacccccuccuccccguccgcuccugguccuacaucgucgagacccccaacuccgagaacggcaucugcuaccccggcgacuucaucgacuacgaggagcuccgcgagcagcucuccuccgucuccuccuucgagcgcuucgagaucuuccccaaggaguccuccuggcccaaccacaacaccaacaagggcgucaccgccgccugcucccacgccggcaaguccuccuucuaccgcaaccuccucuggcucaccgagaaggagggcuccuaccccaagcucaagaacuccuacgucaacaagaagggcaaggagguccucguccucuggggcauccaccaccccuccaacuccaaggaccagcagaaccucuaccagaacgagaacgccuacgucuccgucgucaccuccaacuacaaccgccgcuucacccccgagaucgccgagcgccccaagguccgcgaccaggccggccgcaugaacuacuacuggacccuccucaagcccggcgacaccaucaucuucgaggccaacggcaaccucaucgcccccauguacgccuucgcccucucccgcggcuucggcuccggcaucaucaccuccaacgccuccaugcacgagugcaacaccaagugccagaccccccucggcgccaucaacuccucccuccccuuccagaacauccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacuccgucaucgagaagaugaacauccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaaggucgacggcgucaagcucgaguccaugggcaucuaccagauccucgccaucuacuccaccgucgccuccucccucguccuccucgucucccucggcgccaucuccuucuggaugugcuccaacggcucccuccagugccgcaucugcaucuga

SEQ ID NO: 101676 - RNA, 1698 nt, Artificial Sequence; identical to SEQ ID NO: 94790
  derived and/or modified sequence opt2 from hemagglutinin__InfluenzaA__AGQ47942

SEQ ID NO: 101677 - RNA, 1698 nt, Artificial Sequence
  derived and/or modified sequence opt2 from hemagglutinin__InfluenzaA__AGQ47954
augaaggccaaccuccucguccuccucugcgcccucgccgccgccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggcuccucggcaaccccgagugcgacccccuccuccccguccgcuccugguccuacaucgucgagacccccaacuccgagaacggcaucugcuaccccggcgacuucaucgacuacgaggagcuccgcgagcagcucuccuccgucuccuccuucgagcgcuucgagaucuuccccaaggaguccuccuggcccaaccacaacaccaacggcgucaccgccgccugcucccacgagggcaaguccuccuucuaccgcaaccuccucuggcucaccgagaaggagggcuccuaccccaagcucaagaacuccuacgucaacaagaagggcaaggagguccucguccucuggggcauccaccacccccccaacuccaaggagcagcagaaccucuaccgcaacgagaacgccuacgucuccgucgucaccuccaacuacaaccgccgcuucacccccgagaucgccgagcgccccaagguccgcgaccaggccggccgcaugaacuacuacuggacccuccucaagcccggcgacaccaucaucuucgaggccaacggcaaccucaucgcccccauguacgccuucgcccucucccgcggcuucggcuccggcaucaucaccuccaacgccuccaugcacgagugcaacaccaagugccagaccccccucggcgccaucaacuccucccuccccuaccagaacauccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacaccgucaucgagaagaugaacauccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaaggucgacggcgucaagcucgaguccaugggcaucuaccagauccucgccaucuacuccaccgucgccuccucccucguccuccucgucucccucggcgccaucuccuucuggaugugcuccaacggcucccuccagugccgcaucugcaucuga

SEQ ID NO: 101678 - RNA, 1698 nt, Artificial Sequence
  derived and/or modified sequence opt2 from hemagglutinin__InfluenzaA__AGQ47966
augaaggccaaccuccucguccuccucugcgcccucgccgccgccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggcuccucggcaaccccgagugcgacccccuccuccccgucggcuccugguccuacaucgucgagacccccaacuccgagaacggcaucugcuaccccggcgacuucaucgacuacgaggagcuccgcgagcagcucuccuccgucuccuccuucgagcgcuucgagaucuuccccaaggaguccuccuggcccgaccacaacaccaacggcgucaccgccgccugcucccacgagggcaagaacuccuucuaccgcaaccuccucuggcucaccgagaaggaguccuccuaccccaagcucaagaacuccuacgucaacaagaagggcaaggagguccucguccucuggggcauccaccacccccccaacuccaaggagcagcagaaccucuaccagaacgagaacgccuacgucuccgucgucaccuccaacuacaaccgccgcuucacccccgagaucgccgagcgccccaaggucaaggaccaggccggccgcaugaacuacuacuggacccuccucaagcccggcgacaccaucaucuucgaggccaacggcaaccucaucgcccccauguacgccuucgcccucucccgcggcuucggcuccggcaucaucaccuccaacgccuccaugcacgagugcaacaccaagugccagaccccccucggcgccaucaacuccucccuccccuaccagaacauccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacaccgucaucgagaagaugaacauccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaaggucgacggcgucaagcucgaguccaugggcaucuaccagauccucgccaucuacuccaccgucgccuccucccucguccuccucgucucccucggcgccaucuccuucuggaugugcuccaacggcucccuccagugccgcaucugcaucuga

SEQ ID NO: 101679 - RNA, 1698 nt, Artificial Sequence
  derived and/or modified sequence opt2 from hemagglutinin__InfluenzaA__AGQ47978
augaaggccaaccuccucguccuccucugcgcccucgccgccgccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggcuccucggcaaccccgagugcgacccccuccuccccgucggcuccugguccuacaucgucgagacccccaacuccgagaacggcaucugcuaccccggcgacuucaucgacuacgaggagcuccgcgagcagcucuccuccgucuccuccuucgagcgcuucgagaucuuccccaaggaguccuccuggcccgaccacaacaccaacggcgucaccgccgccugcucccacgagggcaagaacuccuucuaccgcaaccuccucuggcucaccaagaaggaguccuccuaccccgagcucaagaacuccuacgucaacaagaagggcaaggagguccucguccucuggggcauccaccacccccccaacuccaaggagcagcagaaccucuaccagaacgagaacgccuacgucuccgucgucaccuccaacuacaaccgccgcuucacccccgagaucgccgagcgccccaaggucaaggaccaggccggccgcaugaacuacuacuggacccuccucaagcccggcgacaccaucaucuucgaggccaacggcaaccucaucgcccccauguacgccuucgcccucucccgcggcuucggcuccggcaucaucaccuccaacgccuccaugcacgagugcaacaccaagugccagaccccccucggcgccaucaacuccucccuccccuaccagaacauccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacaccgucaucgagaagaugaacauccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaaggucgacggcgucaagcucgaguccaugggcaucuaccagauccucgccaucuacuccaccgucgccuccucccucguccuccucgucucccucggcgccaucuccuucuggaugugcuccaacggcucccuccagugccgcaucugcaucuga

SEQ ID NO: 101680 - RNA, 1698 nt, Artificial Sequence
  derived and/or modified sequence opt2 from hemagglutinin__InfluenzaA__AGQ47990
augaaggccaaccuccucguccuccucugcgcccucgccgccgccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggcuccucggcaaccccgagugcgacccccuccuccccgucggcuccugguccuacaucgucgagacccccaacuccgagaacggcaucugcuaccccggcgacuucaucgacuacgaggagcuccgcgagcagcucuccuccgucuccuccuucgagcgcuucaagaucuuccccaaggaguccuccuggcccgaccacaacaccaacggcgucaccgccgccugcucccacgagggcaagaacuccuucuaccgcaaccuccucuggcucaccaagaaggaguccuccuaccccgagcucaagaacuccuacgucaacaagaagggcaaggagguccucguccucuggggcauccaccacccccccaacuccaaggagcagcagaaccucuaccagaacgagaacgccuacgucuccgucgucaccuccaacuacaaccgccgcuucacccccgagaucgccgagcgccccaaggucaaggaccaggccggccgcaugaacuacuacuggacccuccucaagcccggcgacaccaucaucuucgaggccaacggcaaccucaucgcccccauguacgccuucgcccucucccgcggcuucggcuccggcaucaucaccuccaacgccuccaugcacgagugcaacaccaagugccagaccccccucggcgccaucaacuccucccuccccuaccagaacauccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacaccgucaucgagaagaugaacauccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaaggucgacggcgucaagcucgaguccaugggcaucuaccagauccucgccaucuacuccaccgucgccuccucccucguccuccucgucucccucggcgccaucuccuucuggaugugcuccaacggcucccuccagugccgcaucugcaucuga

SEQ ID NO: 101681 - RNA, 1698 nt, Artificial Sequence
  derived and/or modified sequence opt2 from hemagglutinin__InfluenzaA__AGQ48002
augaaggccaaccuccucguccuccucugcgcccucgccgccgccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggcuccucggcaaccccgagugcgacccccuccuccccgucggcuccugguccuacaucgucgagacccccaacuccgagaacggcaucugcuaccccggcgacuucaucgacuacgaggagcuccgcgagcagcucuccuccgucuccuccuucgagcgcuucaagaucuuccccaaggaguccuccuggcccgaccacaacaccaacggcgucaccgccgccugcucccacgagggcaagaacuccuucuaccgcaaccuccucuggcucaccaagaaggaguccuccuaccccgagcucaagaacuccuacgucaacaagaagcgcaaggagguccucguccucuggggcauccaccacccccccaacuccaaggagcagcagaaccucuaccagaacgagaacgccuacgucuccgucgucaccuccaacuacaaccgccgcuucacccccgagaucgccgagcgccccaaggucaaggaccaggccggccgcaugaacuacuacuggacccuccucaagcccggcgacaccaucaucuucgaggccaacggcaaccucaucgcccccauguacgccuucgcccucucccgcggcuucggcuccggcaucaucaccuccaacgccuccaugcacgagugcaacaccaagugccagaccccccucggcgccaucaacuccucccuccccuaccagaacauccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacaccgucaucgagaagaugaacauccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaaggucgacggcgucaagcucgaguccaugggcaucuaccagauccucgccaucuacuccaccgucgccuccucccucguccuccucgucucccucggcgccaucuccuucuggaugugcuccaacggcucccuccagugccgcaucugcaucuga

SEQ ID NO: 101682 - RNA, 1698 nt, Artificial Sequence
  derived and/or modified sequence opt2 from hemagglutinin__InfluenzaA__AGQ48014
augaaggccaaccuccucguccuccucugcgcccucgccgccgccgacgccgacaccaucugcaucggcuaccacgccaacaacuccaccgacaccgucgacaccguccucgagaagaacgucaccgucacccacuccgucaaccuccucgaggacucccacaacggcaagcucugccgccucaagggcaucgccccccuccagcucggcaagugcaacaucgccggcuggcuccucggcaaccccggcugcgacccccuccuccccgucggcuccugguccuacaucgucgagacccccaacuccgagaacggcaucugcuaccccggcgacuucaucgacuacgaggagcuccgcgagcagcucuccuccgucuccuccuucgagcgcuucaagaucuuccccaaggaguccuccuggcccgaccacaacaccaacggcgucaccgccgccugcucccacgagggcaagaacuccuucuaccgcaaccuccucuggcucaccaagaaggaguccuccuaccccgagcucaagaacuccuacgucaacaagaagcgcaaggagguccucguccucuggggcauccaccacccccccaacuccaaggagcagcagaaccucuaccagaacgagaacgccuacgucuccgucgucaccuccaacuacaaccgccgcuucacccccgagaucgccgagcgccccaaggucaaggaccaggccggccgcaugaacuacuacuggacccuccucaagcccggcgacaccaucaucuucgaggccaacggcaaccucaucgcccccauguacgccuucgcccucucccgcggcuucggcuccggcaucaucaccuccaacgccuccaugcacgagugcaacaccaagugccagaccccccucggcgccaucaacuccucccuccccuaccagaacauccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacaccgucaucgagaagaugaacauccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaaggucgacggcgucaagcucgaguccaugggcaucuaccagauccucgccaucuacuccaccgucgccuccucccucguccuccucgucucccucggcgccaucuccuucuggaugugcuccaacggcucccuccagugccgcaucugcaucuga

SEQ ID NO: 101683 - RNA, 1698 nt, Artificial Sequence
  derived and/or modified sequence opt2 from hemagglutinin__InfluenzaA__AGQ48026
augaaggccaaccuccucguccuccucugcgcccucgccgccgccgacgccgacaccaucugcaucggcuaccacgccaacaacuccaccgacaccgucgacaccguccucgagaagaacgucaccgucacccacuccgucaaccuccucgaggacucccacaacggcaagcucugcaagcucaagggcaucgccccccuccagcucggcaagugcaacaucgccggcuggcuccucggcaaccccggcugcgacccccuccuccccgucggcuccugguccuacaucgucgagacccccaacuccgagaacggcaucugcuaccccggcgacuucaucgacuacgaggagcuccgcgagcagcucuccuccgucuccuccuucgagcgcuucaagaucuuccccaaggaguccuccuggcccgaccacaacaccaacggcgucaccgccgccugcucccacgagggcaagaacuccuucuaccgcaaccuccucuggcucaccaagaaggaguccuccuaccccgagcucaagaacuccuacgucaacaagaagcgcaaggagguccucguccucuggggcauccaccacccccccaacuccaaggagcagcagaaccucuaccagaacgagaacgccuacgucuccgucgucaccuccaacuacaaccgccgcuucacccccgagaucgccgagcgccccaaggucaaggaccaggccggccgcaugaacuacuacuggacccuccucaagcccggcgacaccaucaucuucgaggccaacggcaaccucaucgcccccauguacgccuucgcccucucccgcggcuucggcuccggcaucaucaccuccaacgccuccaugcacgagugcaacaccaagugccagaccccccucggcgccaucaacuccucccuccccuaccagaacauccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacaccgucaucgagaagaugaacauccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaaggucgacggcgucaagcucgaguccaugggcaucuaccagauccucgccaucuacuccaccgucgccuccucccucguccuccucgucucccucggcgccaucuccuucuggaugugcuccaacggcucccuccagugccgcaucugcaucuga

SEQ ID NO: 101684 - RNA, 1698 nt, Artificial Sequence
  derived and/or modified sequence opt2 from hemagglutinin__InfluenzaA__AGQ48038
augaaggccaaccuccucguccuccucugcgcccucgccgccgccgacgccgacaccaucugcaucggcuaccacgccaacaacuccaccgacaccgucgacaccguccucgagaagaacgucaccgucacccacuccgucaaccuccucgaggacucccacaacggcaagcucugcaagcucaagggcaucgccccccuccagcucggcaagugcaacaucgccggcuggcuccucggcaaccccggcugcgacccccuccuccccgucggcuccugguccuacaucgucgagacccccaacuccgagaacggcaucugcuaccccggcgacuucaucgacuacgaggagcuccgcgagcagcucuccuccgucuccuccuucgagcgcuucaagaucuuccccaaggaguccuccuggcccgaccacaacaccaacggcgucaccgccgccugcucccacgagggcaagaacuccuucuaccgcaaccuccucuggcucaccaagaaggaguccuccuaccccgagcucaagaacuccuacgucaacaagaagcgcgaggagguccucguccucuggggcauccaccacccccccaacuccgaggagcagcagaaccucuaccagaacgagaacgccuacgucuccgucgucaccuccaacuacaaccgccgcuucacccccgagaucgccgagcgccccaaggucaagggccaggccggccgcaugaacuacuacuggacccuccucaagcccggcgacaccaucaucuucgaggccaacggcaaccucaucgcccccauguacgccuucgcccucucccgcggcuucggcuccggcaucaucaccuccaacgccuccaugcacgagugcaacaccaagugccagaccccccucggcgccaucaacuccucccuccccuaccagaacauccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacaccgucaucgagaagaugaacauccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaaggucgacggcgucaagcucgaguccaugggcaucuaccagauccucgccaucuacuccaccgucgccuccucccucguccuccucgucucccucggcgccaucuccuucuggaugugcuccaacggcucccuccagugccgcaucugcaucuga

SEQ ID NO: 101685 - RNA, 1698 nt, Artificial Sequence
  derived and/or modified sequence opt2 from hemagglutinin__InfluenzaA__AGQ48050
augaaggccaaccuccucguccuccucugcgcccucgccgccgccgacgccgacaccaucugcaucggcuaccacgccaacaacuccaccgacaccgucgacaccguccucgagaagaacgucaccgucacccacuccgucaaccuccucgaggacucccacaacggcaagcucugcaagcucaagggcaucgccccccuccagcucggcaagugcaacaucgccggcuggcuccucggcaaccccggcugcgacccccuccuccccgucggcuccugguccuacaucgucgagacccccaacuccgagaacggcaucugcuaccccggcgacuucaucgacuacgaggagcuccgcgagcagcucuccuccgucuccuccuucgagcgcuucaagaucuuccccaaggaguccuccuggcccgaccacaacaccaacggcgucaccgccgccugcucccacgagggcaagaacuccuucuaccgcaaccuccucuggcucaccaagaaggaguccuccuaccccgagcucaagaacuccuacgucaacaagaagcgcgaggagguccucguccucuggggcauccaccacccccccgacuccgaggagcagcagaaccucuaccagaacgagaacgccuacgucuccgucgucaccuccaacuacaaccgccgcuucacccccgagaucgccgagcgccccaaggucaagggccaggccggccgcaugaacuacuacuggacccuccucaagcccggcgacaccaucaucuucaaggccaacggcaaccucaucgcccccauguacgccuucgcccucucccgcggcuucggcuccggcaucaucaccuccaacgccuccaugcacgagugcaacaccaagugccagaccccccucggcgccaucaacuccucccuccccuaccagaacauccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucaacggcaucaccaacaaggucaacaccgucaucgagaagaugaacauccaguucaccgccgucggcaaggaguucaacaagcucgagaagcgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcgacaacgagugcauggaguccguccgcaacggcaccuacgacuaccccaaguacuccgaggaguccaagcucaaccgcgagaaggucgacggcgucaagcucgaguccaugggcaucuaccagauccucgccaucuacuccaccgucgccuccucccucguccuccucgucucccucggcgccaucuccuucuggaugugcuccaacggcucccuccagugccgcaucugcaucuga

SEQ ID NO: 101686 - RNA, 1689 nt, Artificial Sequence
  derived and/or modified sequence opt2 from hemagglutinin__InfluenzaA__AGQ80946
auggccaucaucuaccucauccuccucuucaccgccguccgcggcgaccagaucugcaucggcuaccacuccaacaacuccaccgagaaggucgacaccauccucgagcgcaacgucaccgucacccacgcccaggacauccucgagaagacccacaacggcaagcucugcaagcucaacggcauccccccccucgagcucggcgacugcuccaucgccggcuggcuccucggcaaccccgagugcgaccgccuccucaccguccccgagugguccuacaucauggagaaggagaacccccgcaacggccucugcuaccccggcuccuucaacgacuacgaggagcucaagcaccuccucuccuccgucacccacuucgagaaggucaagauccuccccaaggaccgcuggacccagcacaccaccaccggcggcucccgcgccugcgccgucuccggcaaccccuccuucuuccgcaacauggucuggcucaccaagaagggccccaacuaccccgucgccaagggcuccuacaacaacaccuccggcgaccagaugcucaucaucuggggcguccaccaccccaacgacgaggccgagcagcgcacccucuaccagaacgucggcaccuacgucuccgucggcaccuccacccucaacaagcgcuccguccccgagaucgccacccgccccaaggucaacggccagggcggccgcauggaguucuccuggaccauccucgacguccucgacaccaucaacuucgaguccaccggcaaccucaucgcccccgaguacggcuucaagaucuccaagcgcggcuccuccggcaucaugaagaccgagggcacccucgagaacugcgagaccaagugccagaccccccucggcgccaucaacaccacccuccccuuccacaacauccacccccucaccaucggcgagugccccaaguacgucaaguccgagcgccucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccaucgacggcaucaccaacaaggucaacuccgucaucgagaagaugaacacccaguucgaggccgucggcaaggaguucuccaaccucgagaagcgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgccaaggagcucggcaacggcugcuucgaguucuaccacaagugcgacgacgagugcaugaacuccgucaagaacggcaccuacgacuaccccaaguacgaggaggaguccaagcucaaccgcaacgagaucaagggcgucaagcucuccaacaugggcgucuaccagauccucgccaucuacgccaccgucgccggcucccucucccucgccaucaugaucgccggcaucucccucuggaugugcuccaacggcucccuccagugccgcaucugcaucuga

SEQ ID NO: 101687 - RNA, 1689 nt, Artificial Sequence
  derived and/or modified sequence opt2 from hemagglutinin__InfluenzaA__AGQ80947
auggccaucaucuaccucauccuccucuucgccaccguccgcggcgaccagaucugcaucggcuaccacuccaacaacuccaccgagaaggucgacaccauccucgagcgcaacaucaccgucacccacgcccaggacauccucgagaagacccacaacggcaagcucugcaagcucaacggcauccccccccucgagcucggcaacugcuccaucgccggcuggcuccucggcaaccccgagugcgaccgccuccucaccguccccgagugguccuacaucauggagaaggagaacccccgcgacggccucugcuaccccggcuccuucaacgacuacgaggagcucaagcaccuccucuccuccgucacccacuucgagaaggucaagauccuccccaaggaccgcuggacccagcacaccaccaccggcggcucccgcgccugcgccgucuccggcaaccccuccuucuuccgcaacauggucuggcucaccaagaagggcuccaacuaccccaucgccaagggcuccuacaacaacaccuccggcgagcagaugcucaucaucuggggcguccaccaccccaacgacgacgccgagcagcgcacccucuaccagaacgucggcaccuacgucuccgucggcaccuccacccucaacaagcgcuccauccccgagaucgccacccgccccaaggucaacggccagggcggccgcauggaguucuccuggaccauccucgacaugcucgacaccaucaacuucgaguccaccggcaaccucaucgcccccgaguacggcuucaagaucuccaagcgcggcuccuccggcaucaugaagaccgagggcacccucgagaacugcgagaccaagugccagaccccccucggcgccaucaacaccacccuccccuuccacaacauccacccccucaccaucggcgagugccccaaguacgucaaguccgagcgccucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccaucgacggcaucaccaacaaggucaacuccgucaucgagaagaugaacacccaguucgaggccgucggcaaggaguucaacaaccucgagaagcgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcucaaggacaacgccaaggagcucggcaacggcugcuucgaguucuaccacaagugcgacgacgagugcaugaacuccgucaagaacggcaccuacgacuaccccaaguacgaggaggaguccaagcucaaccgcaacgagaucaagggcgucaagcucuccaacaugggcgucuaccagauccucgccaucuacgccaccgucgccggcucccucucccucgccaucaugaucgccggcgucucccucuggaugugcuccaacggcucccuccagugccgcaucugcaucuga

SEQ ID NO: 101688 - RNA, 1689 nt, Artificial Sequence
  derived and/or modified sequence opt2 from hemagglutinin__InfluenzaA__AGQ80948
auggccaucaucuaccucauccuccucuucgccgccguccgcggcgaccagaucugcaucggcuaccacuccaacaacuccaccgagaaggucgacaccauccucgagcgcaacgucaccgucacccacgcccaggacauccucgagaagacccacaacggcaagcucugcaagcucaacggcauccccccccucgagcucggcaacugcuccaucgccggcuggcuccucggcaaccccgagugcgaccgccuccucaccguccccgagugguccuacaucauggagaaggagaacccccgcaacggccucugcuaccccggcuccuucaacgacuacgaggagcucaagcaccuccucuccuccgucacccacuucgagaaggucaagauccuccccaaggaccgcuggacccagcacaccaccaccggcggcucccgcgccugcgccgucuucggcaaccccuccuucuuccgcaacauggucuggcucaccaagaagggcuccaacuaccccaucgccaagggcuccuacaacaacaccuccggcgagcagaugcucaucaucuggggcguccaccaccccaacgacgacgccgagcagcgcacccucuaccagaacgucggcaccuacgucuccgucggcaccuccacccucaacaagcgcuccauccccgagaucgccacccgccccaaggucaacggccagggcggccgcauggaguucuccuggaccauccucgacaugcucgacaccaucaacuucgaguccaccggcaaccucaucgcccccgaguacggcuucaagaucuccaagcgcggcuccuccggcaucaugaagaccgagggcacccucgagaacugcgagaccaagugccagaccccccucggcgccaucaacaccacccuccccuuccacaacauccacccccucaccaucggcgagugccccaaguacgucaaguccgagcgccucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccaucgacggcaucaccaacaaggucaacuccgucaucgagaagaugaacacccaguucgaggccgucggcaaggaguucaacaaccucgagaagcgccucgagaaccucaacaagaagauggaggacggcuuccucgacgucuggaccuacaacgccgagcuccucguccucauggagaacgagcgcacccucgacuuccacgacuccaacgucaagaaccucuacgacaagauccgcaugcagcucaaggacaacgccaaggagcucggcaacggcugcuucgaguucuaccacaagugcgacgacgagugcaugaacuccgucaagaacggcaccuacgacuaccccaaguacgaggaggaguccaagcucaaccgcaacgagaucaagggcgucaagcucuccaacaugggcgucuaccagauccucgccaucuacgccaccgucgccggcucccucucccucgccaucaugaucgccggcaucucccucuggaugugcuccaacggcucccuccagugccgcaucugcaucuga

SEQ ID NO: 101689 - RNA, 1689 nt, Artificial Sequence
  derived and/or modified sequence opt2 from hemagglutinin__InfluenzaA__AGQ80949
auggccaucaucuaccucauccuccucuucgccgccguccgcggcgaccagaucugcaucggcuaccacuccaacaacuccaccgagaaggucgacaccauccucgagcgcaacgucaccgucacccacgcccaggacauccucgagaagacccacaacggcaagcucugcaagcucaacggcauccccccccucgagcucggcgacugcuccaucgccggcuggcuccucggcaaccccgagugcgaccgccuccucaccguccccgagugguccuacaucauggagaaggagaacccccgcaacggccucugcuaccccggcuccuucaacgacuacgaggagcucaagcaccuccucuccuccgucacccacuucgagaaggucaagauccuccccaaggaccgcuggacccagcacaccaccaccggcggcucccgcgccugcgccgucuccggcaaccccuccuucuuccgcaacauggucuggcucaccaagaagggcuccaacuaccccaucgccaagggcuccuacaacaacaccuccggcgagcagaugcucaucaucuggggcguccaccaccccaacgacgacgccgagcagcgcacccucuaccagaacgucggcaccuacgucuccgucggcaccuccacccucaacaagcgcuccauccccgagaucgccacccgccccaaggucaacggccagggcggccgcauggaguucuccuggaccauccucgacaugcucgacaccaucaacuucgaguccaccggcaaccucaucgcccccgaguacggcuucaagaucuccaagcgcggcuccuccggcaucaugaagaccgagggcacccucgagaacugcgagaccaagugccagaccccccucggcgccaucaacaccacccuccccuuccacaacauccacccccucaccaucggcgagugccccaaguacgucaaguccgagcgccucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccaucgacggcaucaccaacaaggucaacuccgucaucgagaagaugaacacccaguucgaggccgucggcaaggaguucaacaaccucgagaagcgccucgagaaccucaacaagaagauggaggacggcuuccucgacgucuggaccuacaacgccgagcuccucguccucauggagaacgagcgcacccucgacuuccacgacuccaacgucaagaaccucuacgacaagauccgcaugcagcucaaggacaacgccaaggagcucggcaacggcugcuucgaguucuaccacaagugcgacgacgagugcaugaacuccgucaagaacggcaccuacgacuaccccaaguacgaggaggaguccaagcucaaccgcaacgagaucaagggcgucaagcucuccaacaugggcgucuaccagauccucgccaucuacgccaccgucgccggcucccucucccucgccaucaugaucgccggcaucucccucuggaugugcuccaacggcucccuccagugccgcaucugcaucuga

SEQ ID NO: 101690 - RNA, 1701 nt, Artificial Sequence
  derived and/or modified sequence opt2 from hemagglutinin__InfluenzaA__AGQ80950
augaagaccaucaucgcccucuccuacaucuucugccucgccuucggccagaaccuccccggcaacgacuccuccaccgccacccucugccucggccaccacgccguccucaacggcaccaucgucaagaccaucaccgacgaccagaucgaggucaccaacgccaccgagcucguccaguccuccuccaccggcaagaucugcaacaacccccacaagauccucgacggccgcgacugcacccucaucgacgcccuccucggcgacccccacugcgacgucuuccaggacgagaccugggaccucuucgucgagcgcuccuccgccuucuccaacugcuaccccuacgacguccccgacuacgccucccuccgcucccucgucgccuccuccggcacccucgaguucaucaccgagggcuucaccuggaccggcgucucccagaacggcggcuccggcgccugcaagcgcggccccgccaacggcuucuucucccgccucaacuggcucaccaaguccggcaacgccuaccccguccucaacgucaccaugcccaacuccgacaacuucgacaagcucuacaucuggggcguccaccaccccuccaccaaccaggagcagaccaaccucuacguccaggccuccggccgcgucaccgucuccacccgccgcucccagcagaccaucauccccaacaucggcucccgccccuggguccgcggccaguccggccgcaucuccaucuacuggaccaucgucaagcccggcgacguccucgucaucaacuccaacggcaaccucaucgccccccgcggcuacuucaagaugcgcaccggcaaguccuccaucaugcgcuccgacgcccccaucgagaccugcaucuccgagugcaucacccccaacggcuccauccccaacgacaagcccuuccagaacgucaacaagaucaccuacggcgccugccccaaguacgucaagcagaacacccucaagcucgccaccggcaugcgcaacguccccgagaagcagacccgcggccucuucggcgccaucgccggcuucaucgagaacggcugggagggcaugaucgacggcugguacggcuuccgccaccagaacuccgagggcaccggccaggccgccgaccucaaguccacccaggccgccaucgaccagaucaacggcaagcucaaccgcgucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgccgccagcuccgcgagaacgccgaggacaugggcaacggcugcuucaagaucuaccacaagugcgacaacgccugcaucgaguccauccgcaacggcaccuacgaccacgacaucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagcgcggcaacauccgcugcaacaucugcaucuga

SEQ ID NO: 101691 - RNA, 1695 nt, Artificial Sequence
  derived and/or modified sequence opt2 from hemagglutinin__InfluenzaA__AGQ80951
augcucuccaucgucauccucuuccuccucgucgccgaguccuccucccagaacuacaccggcaaccccgucaucugcaugggccaccacgccgucgccaacggcaccauggucaagacccucaccgacgaccaggucgaggucgucaccgcccaggagcucgucgagucccagaaccuccccgagcucugccccuccccccuccgccucgucgacggccagaccugcgacaucaucaacggcgcccucggcucccccggcugcgaccaccucaacggcgccgagugggacaucuucaucgagcgccccaacgccauggacaccugcuaccccuucgacguccccgacuaccagucccuccgcuccauccucgccaacaacggcaaguucgaguucaucgccgaggaguuccagugguccaccgucaagcagaacggcaaguccggcgccugcaagcgcgccaacgucaacgacuucuucaaccgccucaacuggcucgucaaguccgacggcaacgccuacccccuccagaaccucaccaaggucaacaacggcgacuacgcccgccucuacaucuggggcguccaccaccccuccaccgacaccgagcagaccaaccucuacaagaacaaccccggccgcgucaccgucuccaccaagaccucccagaccuccgucguccccaacaucggcucccgccccuggguccgcggccaguccggccgcaucuccuucuacuggaccaucgucgagcccggcgaccucaucgucuucaacaccaucggcaaccucaucgccccccgcggccacuacaagcucaacucccagaagaaguccaccauccucaacaccgccacccccaucggcuccugcgucuccaagugccacaccgacaagggcucccucuccaccaccaagcccuuccagaacaucucccgcgucgccaucggcgacugccccaaguacgucaagcagggcucccucaagcucgccaccggcaugcgcaacauccccgagaaggccucccgcggccucuucggcgccaucgccggcuucaucgagaacggcuggcagggccucaucgacggcugguacggcuuccgccaccagaacgccgagggcaccggcaccgccgccgaccucaaguccacccaggccgccaucgaccagaucaacggcaagcucaaccgccucaucgagaagaccaacgagaaguaccaccagaucgagaaggaguucgagcaggucgagggccgcauccaggaccucgagaaguacgucgaggacaccaagaucgaccucugguccuacaacgccgagcuccucgucgcccucgagaaccagcacaccaucgacgucaccgacuccgagaugaacaagcucuucgagcgcguccgccgccagcuccgcgagaacgccgaggacaagggcaacggcugcuucgagaucuuccacaagugcgacaacaacugcaucgaguccauccgcaacggcaccuacgaccacgacgucuaccgcaacgaggccaucaacaaccgcuuccagauccagggcgucaagcucacccagggcuacaaggacaucauccucuggaucuccuucuccaucuccugcuuccuccucgucgcccuccuccucgccuucauccucugggccugccagaacggcaacauccgcugccagaucugcaucuga

SEQ ID NO: 101692 - RNA, 1683 nt, Artificial Sequence
  derived and/or modified sequence opt2 from hemagglutinin__InfluenzaA__AGQ80953
augaacacccagauccucgucuucgcccucgucgccaucauccccaccaacgccgacaagaucugccucggccaccacgccgucuccaacggcaccaaggucaacacccucaccgagcgcggcgucgaggucgucaacgccaccgagaccgucgagcgcaccuccaucccccgcaucugcuccaagggcaagcgcgccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggagaccaugggcuucaccuacuccggcauccgcaccaacggcgccaccuccgccugccgccgcuccggcuccuccuucuacgccgagaugaaguggcuccucuccaacaccgacaacgccgccuucccccagaccaccaaguccuacaagaacacccgcaaggaccccgcccucaucaucuggggcauccaccacuccggcuccaccaccgagcagaccaagcucuacggcuccggcaacaagcucaucaccgucggcuccuccaacuaccagcaguccuucguccccucccccggcgcccgcccccaggucaacggccaguccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacaacggcggcaccaucaucuccaaccuccccuuccagaacaucaacucccgcgccgucggcaagugcccccgcuacgucaagcaggagucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucgaccagaucaccggcaagcucaaccgccucaucgagaagaccaaccagcaguucgagcucaucgacaacgaguucaccgaggucgagcgccagaucggcaacgucaucaacuggacccgcgacuccaugaccgaggucugguccuacaacgccgagcuccucgucgccauggagaaccagcacaccaucgaccucgccgacuccgagaugaacaagcucuacgagcgcguccgccgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgccaugggccucgucuucaucugcgucaagaacggcaacaugcgcugcaccaucugcaucuga

SEQ ID NO: 101693 - RNA, 1683 nt, Artificial Sequence; identical to SEQ ID NO: 101692
  derived and/or modified sequence opt2 from hemagglutinin__InfluenzaA__AGQ80954

SEQ ID NO: 101694 - RNA, 1683 nt, Artificial Sequence; identical to SEQ ID NO: 101692
  derived and/or modified sequence opt2 from hemagglutinin__InfluenzaA__AGQ80955

SEQ ID NO: 101695 - RNA, 1683 nt, Artificial Sequence; identical to SEQ ID NO: 101692
  derived and/or modified sequence opt2 from hemagglutinin__InfluenzaA__AGQ80956

SEQ ID NO: 101696 - RNA, 1683 nt, Artificial Sequence; identical to SEQ ID NO: 101692
  derived and/or modified sequence opt2 from hemagglutinin__InfluenzaA__AGQ80957

SEQ ID NO: 101697 - RNA, 1683 nt, Artificial Sequence; identical to SEQ ID NO: 101692
  derived and/or modified sequence opt2 from hemagglutinin__InfluenzaA__AGQ80958

SEQ ID NO: 101698 - RNA, 1683 nt, Artificial Sequence
  derived and/or modified sequence opt2 from hemagglutinin__InfluenzaA__AGQ80959
augaacacccagauccucgucuucgcccucaucgccaucauccccaccaacgccgacaagaucugccucggccaccacgccgucuccaacggcaccaaggucaacacccucaccgagcgcggcgucgaggucgucaacgccaccgagaccgucgagcgcaccaacaucccccgcaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggaggccaugggcuucaccuacuccggcauccgcaccaacggcgccaccuccgccugccgccgcuccggcuccuccuucuacgccgagaugaaguggcuccucuccaacaccgacaacgccgccuucccccagaugaccaaguccuacaagaacacccgcaaggaccccgcccucaucaucuggggcauccaccacuccggcuccaccgccgagcagaccaagcucuacggcuccggcaacaagcucgucaccgucggcuccuccaacuaccagcaguccuucguccccucccccggcgcccgcccccaggucaacggccaguccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacggcggcggcaccaucaucuccaaccuccccuuccagaacaucgacucccgcgccgucggcaagugcccccgcuacgucaagcagaagucccuccuccucgccaccggcaugaagaacguccccgagucccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucgaccagaucaccggcaagcucaaccgccucaucgagaagaccaaccagcaguucgagcucaucgacaacgaguucaccgaggucgagaagcagaucggcaacgucaucaacuggacccgcgacuccaucaccgaggucugguccuacaacgccgagcuccucgucgccauggagaaccagcacaccaucgaccucgccgacuccgagaugaacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgccaugggccucgucuucaucugcgucaagaacggcaacaugcgcugcaccaucugcaucuga

SEQ ID NO: 101699 - RNA, 1683 nt, Artificial Sequence
  derived and/or modified sequence opt2 from hemagglutinin__InfluenzaA__AGQ80961
augaacacccagauccucgucuucgcccucgucgccaucauccccaccaacgccgacaagaucugccucggccaccacgccgucuccaacggcaccaaggucaacacccucaccgagcgcggcgucgaggucgucaacgccaccgagaccgucgagcgcaccaacguccccaagaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggagacccuccgccagauccuccgcgaguccggcggcaucgacaaggagaccaugggcuucaccuacuccggcauccgcaccaacggcgccaccuccgccugccgccgcuccggcuccuccuucuacgccgagaugaaguggcuccucuccaacaccgacaacgccgccuucccccagaugaccaaguccuacaagaacgcccgcaaggaccccgcccucaucaucuggggcauccaccacuccggcuccaccaccgagcagaccaagcucuacggcuccggcaacaagcucaucaccgucggcuccuccaacuaccagcaguccuucguccccucccccggcgcccgcccccaggucaacggccaguccggccgcaucgacuuccacuggcucaugcucaaccccaacgacaccgucaccuucuccuucaacggcgccuucaucgcccccgaccgcgccugcuuccuccgcggcaaguccaugggcauccaguccggcguccaggucgacgccuccugcgagggcgacugcuaccacuccggcggcaccaucaucuccaaccuccccuuccagaacaucaacucccgcgccgucggcaagugcccccgcuacgucaagcaggagucccucaugcucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucgaccagaucaccggcaagcucaaccgccucaucgagaagaccaaccagcaguucgagcucaucgacaacgaguucaccgaggucgagaagcagaucggcaacgucaucaacuggacccgcgacuccaugaccgaggucugguccuacaacgccgagcuccucgucgccauggagaaccagcacaccaucgaccucgccgacuccgagaugaacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcaucaagaucgaccccgucaagcucuccuccggcuacaaggacgucauccucugguucuccuucggcgccuccugcuucauccuccucgccaucgccaugggccucgucuucaucugcgucaagaacggcaacaugcgcugcaccaucugcaucuga

SEQ ID NO: 101700 - RNA, 1683 nt, Artificial Sequence; identical to SEQ ID NO: 101699
  derived and/or modified sequence opt2 from hemagglutinin__InfluenzaA__AGQ80962

SEQ ID NO: 101701 - RNA, 1683 nt, Artificial Sequence
  derived and/or modified sequence opt2 from hemagglutinin__InfluenzaA__AGQ80964
augaacacccagauccucgucuucgcccucaucgccaucauccccaccaacgccgacaagaucugccucggccaccacgccgucuccaacggcaccaaggucaacacccucaccgagcgcggcgucgaggucgucaacgccaccgagaccgucgagcgcaccaacaucccccgcaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggaggccaugggcuucaccuacuccggcauccgcaccaacggcgccaccuccgccugccgccgcuccggcuccuccuucuacgccgagaugaaguggcuccucuccaacaccgacaacgccgccuucccccagaugaccaaguccuacaagaacacccgcaaggaccccgcccucaucaucuggggcauccaccacuccggcuccaccgccgagcagaccaagcucuacggcuccggcaacaagcucgucaccgucggcuccuccaacuaccagcaguccuucguccccucccccggcgcccgcccccaggucaacggccaguccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccgacugcgagggcgacugcuaccacuccggcggcaccaucaucuccaaccuccccuuccagaacaucgacucccgcgccgucggcaagugcccccgcuacgucaagcagcgcucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucgaccagaucaccggcaagcucaaccgccucaucgagaagaccaaccagcaguucgagcucaucgacaacgaguucaccgaggucgagaagcagaucggcaacgucaucaacuggacccgcgacuccaucaccgaggucugguccuacaacgccgagcuccucgucgccauggagaaccagcacaccaucgaccucgccgacuccgagaugaacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgccaugggccucgucuucaucugcgucaagaacggcaacaugcgcugcaccaucugcaucuga

SEQ ID NO: 101702 - RNA, 1683 nt, Artificial Sequence; identical to SEQ ID NO: 101692
  derived and/or modified sequence opt2 from hemagglutinin__InfluenzaA__AGQ80965

SEQ ID NO: 101703 - RNA, 1683 nt, Artificial Sequence; identical to SEQ ID NO: 101692
  derived and/or modified sequence opt2 from hemagglutinin__InfluenzaA__AGQ80966

SEQ ID NO: 101704 - RNA, 1683 nt, Artificial Sequence; identical to SEQ ID NO: 101692
  derived and/or modified sequence opt2 from hemagglutinin__InfluenzaA__AGQ80968

SEQ ID NO: 101705 - RNA, 1683 nt, Artificial Sequence
  derived and/or modified sequence opt2 from hemagglutinin__InfluenzaA__AGQ80970
augaacacccagauccucgucuucgcccucgucgccaucauccccaccaacgccgacaagaucugccucggccaccacgccgucuccaacggcaccaaggucaacacccucaccgagcgcggcgucgaggucgucaacgccaccgagaccgucgagcgcaccuccaucccccgcaucugcuccaagggcaagaaggccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggagaccaugggcuucaccuacuccggcauccgcaccaacggcgccaccuccgccugccgccgcuccggcuccuccuucuacgccgagaugaaguggcuccucuccaacaccgacaacgccgccuucccccagaccaccaaguccuacaagaacacccgcaaggaccccgcccucaucaucuggggcauccaccacuccggcuccaccaccgagcagaccaagcucuacggcuccggcaacaagcucaucaccgucggcuccuccaacuaccagcaguccuucguccccucccccggcgcccgcccccaggucaacggccaguccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacaacggcggcaccaucaucuccaaccuccccuuccagaacaucaacucccgcgccgucggcaagugcccccgcuacgucaagcaggagucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucgaccagaucaccggcaagcucaaccgccucaucgagaagaccaaccagcaguucgagcucaucgacaacgaguucaccgaggucgagcgccagaucggcaacgucaucaacuggacccgcgacuccaugaccgaggucugguccuacaacgccgagcuccucgucgccauggagaaccagcacaccaucgaccucgccgacuccgagaugaacaagcucuacgagcgcguccgccgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgccaugggccucgucuucaucugcgucaagaacggcaacaugcgcugcaccaucugcaucuga

SEQ ID NO: 101706 - RNA, 1683 nt, Artificial Sequence
  derived and/or modified sequence opt2 from hemagglutinin__InfluenzaA__AGQ80971
augaacacccagauccucgucuucgcccucgucgccaucauccccaccaacgccgacaagaucugccucggccaccacgccgucuccaacggcaccaaggucaacacccucaccgagcgcggcgucgaggucgucaacgccaccgagaccgucgagcgcaccuccaucccccgcaucugcuccaagggcaagaagaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggagaccaugggcuucaccuacuccggcauccgcaccaacggcgccaccuccgccugccgccgcuccggcuccuccuucuacgccgagaugaaguggcuccucuccaacaccgacaacgccgccuucccccagaccaccaaguccuacaagaacacccgcaaggaccccgcccucaucaucuggggcauccaccacuccggcuccaccaccgagcagaccaagcucuacggcuccggcaacaagcucaucaccgucggcuccuccaacuaccagcaguccuucguccccucccccggcgcccgcccccaggucaacggccaguccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacaacggcggcaccaucaucuccaaccuccccuuccagaacaucaacucccgcgccgucggcaagugcccccgcuacgucaagcaggagucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucgaccagaucaccggcaagcucaaccgccucaucgagaagaccaaccagcaguucgagcucaucgacaacgaguucaccgaggucgagcgccagaucggcaacgucaucaacuggacccgcgacuccaugaccgaggucugguccuacaacgccgagcuccucgucgccauggagaaccagcacaccaucgaccucgccgacuccgagaugaacaagcucuacgagcgcguccgccgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgccaugggccucgucuucaucugcgucaagaacggcaacaugcgcugcaccaucugcaucuga

SEQ ID NO: 101707 - RNA, 1683 nt, Artificial Sequence
  derived and/or modified sequence opt2 from hemagglutinin__InfluenzaA__AGQ80974
augaacacccagauccucgucuucgcccucgucgccaucauccccaccaacgccgacaagaucugccucggccaccacgccgucuccaacggcaccaaggucaacacccucaccgagcgcggcgucgaggucgucaacgccaccgagaccgucgagcgcaccuccaucccccgcaucugcuccaagggcaagcgcgccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggagaccaugggcuucaccuacuccggcauccgcaccaacggcgccaccuccgccugccgccgcuccggcuccuccuucuacgccgagaugaaguggcuccucuccaacaccgacaacgccgccuucccccagaccaccaaguccuacaagaacacccgcaaggaccccgcccucaucaucuggggcauccaccacuccggcuccaccaccgagcagaccaagcucuacggcuccggcaacaagcucaucaccgucggcuccuccaacuaccagcaguccuucguccccucccccggcgcccgcccccaggucaacggccaguccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacaacggcggcaccaucaucuccaaccuccccuuccagaacaucaacucccgcgccgucggcaagugcccccgcuacgucaagcaggagucccuccuccucgccaccggcaugaagaacguccccgagauccccaagggccgcggccucuucggcgccaucgccggcuucaucgagaacggcugggagggccucgucgacggcugguacggcuuccgccaccagaacgcccagggcgagggcaccgccgccgacuacaaguccacccaguccgccaucgaccagaucaccggcaagcucaaccgccucaucgagaagaccaaccagcaguucgagcucaucgacaacgaguucaccgaggucgagcgccagaucggcaacgucaucaacuggacccgcgacuccaugaccgaggucugguccuacaacgccgagcuccucgucgccauggagaaccagcacaccaucgaccucgccgacuccgagaugaacaagcucuacgagcgcguccgccgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgccaugggccucgucuucaucugcgucaagaacggcaacaugcgcugcaccaucugcaucuga

SEQ ID NO: 101708 - RNA, 1683 nt, Artificial Sequence
  derived and/or modified sequence opt2 from hemagglutinin__InfluenzaA__AGQ80977
augaacacccagauccucgcccucgcccucgccgccaucauccccaccaacgccgacaagaucugccucggccaccacgccgucuccaacggcaccaaggucaacacccucaccgagcgcggcgucgaggucgucaacgccaccgagaccgucgagcgcaccuccaucccccgcaucugcuccaagggcaagcgcgccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggagaccaugggcuucaccuacuccggcauccgcaccaacggcgccaccuccgccugccgccgcuccggcuccuccuucuacgccgagaugaaguggcuccucuccaacaccgacaacgccgccuucccccagaccaccaaguccuacaagaacacccgcaaggaccccgcccucaucaucuggggcguccaccacuccggcuccaccaccgagcagaccaagcucuacggcuccggcaacaagcucaucaccgucggcuccuccaacuaccagcaguccuucguccccucccccggcgcccgcccccaggucaacggccaguccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacaacggcggcaccaucaucuccaaccuccccuuccagaacaucaacucccgcgccgucggcaagugcccccgcuacgucaagcaggagucccuccuccucgccaccggcaugaagaacguccccgagauccccaagggccgcggccucuucggcgccaucgccggcuucaucgagaacggcugggagggccucgucgacggcugguacggcuuccgccaccagaacgcccagggcgagggcaccgccgccgacuacaaguccacccaguccgccaucgaccagaucaccggcaagcucaaccgccucaucgagaagaccaaccagcaguucgagcucaucgacaacgaguucaccgaggucgagcgccagaucggcaacgucaucaacuggacccgcgacuccaugaccgaggucugguccuacaacgccgagcuccucgucgccauggagaaccagcacaccaucgaccucgccgacuccgagaugaacaagcucuacgagcgcguccgccgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgccaugggccucgucuucaucugcgucaaguccggcaacaugcgcugcaccaucugcaucuga

SEQ ID NO: 101709 - RNA, 1683 nt, Artificial Sequence
  derived and/or modified sequence opt2 from hemagglutinin__InfluenzaA__AGQ80978
augaacacccagauccucgucuucgcccucgucgccaucauccccaccaacgccgacaagaucugccucggccaccacgccgucuccaacggcaccaaggucaacacccucaccgagcgcggcgucgaggucgucaacgccaccgagaccgucgagcgcaccuccaucccccgcaucugcuccaagggcaagcgcgccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggagaccaugggcuucaccuacuccggcauccgcaccaacggcgccaccuccgccugccgccgcuccggcuccuccuucuacgccgagaugaaguggcuccucuccaacaccgacaacgccgccuucccccagaccaccaaguccuacaagaacacccgcaaggaccccgcccucaucaucuggggcauccaccacuccggcuccaucaccgagcagaccaagcucuacggcuccggcaacaagcucaucaccgucggcuccuccaacuaccagcaguccuucguccccucccccggcgcccgcccccaggucaacggccaguccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacaacggcggcaccaucaucuccaaccuccccuuccagaacaucaacucccgcgccgucggcaagugcccccgcuacgucaagcaggagucccuccuccucgccaccggcaugaagaacguccccgagauccccaagggccgcggccucuucggcgccaucgccggcuucaucgagaacggcugggagggccucgucgacggcugguacggcuuccgccaccagaacgcccagggcgagggcaccgccgccgacuacaaguccacccaguccgccaucgaccagaucaccggcaagcucaaccgccucaucgagaagaccaaccagcaguucgagcucaucgacaacgaguucaccgaggucgagcgccagaucggcaacgucaucaacuggacccgcgacuccaugaccgaggucugguccuacaacgccgagcuccucgucgccauggagaaccagcacaccaucgaccucgccgacuccgagaugaacaagcucuacgagcgcguccgccgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgccaugggccucgucuucaucugcgucaagaacggcaacaugcgcugcaccaucugcaucuga

SEQ ID NO: 101710 - RNA, 1683 nt, Artificial Sequence
  derived and/or modified sequence opt2 from hemagglutinin__InfluenzaA__AGQ80979
augaacacccagauccucgucuucgcccucgucgccaucauccccaccaacgccgacaagaucugccucggccaccacgccgucuccaacggcaccaaggucaacacccucaccgagcgcggcgucgaggucgucaacgccaccgagaccgucgagcgcaccuccaucccccgcaucugcuccaagggcaagcgcgccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggagaccaugggcuucaccuacuccggcauccgcaccaacggcgccaccuccgccugccgccgcuccggcuccuccuucuacgccgagaugaaguggcuccucuccaacaccgacaacgccgccuucccccagaccaccaaguccuacaagaacacccgcaaggaccccgcccucaucaucuggggcauccaccacuccggcuccaccaccgagcagaccaagcucuacggcuccggcaacaagcucaucaccgucggcuccuccaacuaccagcaguccuucguccccucccccggcgcccgcccccaggucaacggccaguccggccgcaucgacuuccacuggcucaugcucaaccccaacgacaccgucaccuucuccuucaacggcgccuucaucgcccccgaccgcgccuccuuccuccgcggcaaguccaucggcauccaguccggcguccaggucgacgccaacugcgagggcgacugcuaccacaacggcggcaccaucaucuccaaccuccccuuccagaacaucaacucccgcgccgucggcaagugcccccgcuacgucaagcaggagucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucgaccagaucaccggcaagcucaaccgccucaucgagaagaccaaccagcaguucgagcucaucgacaacgaguucaccgaggucgagcgccagaucggcaacgucaucaacuggacccgcgacuccaugaccgaggucugguccuacaacgccgagcuccucgucgccauggagaaccagcacaccaucgaccucgccgacuccgagaugaacaagcucuacgagcgcguccgccgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgccaugggccucgucuucaucugcgucaagaacggcaacaugcgcugcaccaucugcaucuga

SEQ ID NO: 101711 - RNA, 1683 nt, Artificial Sequence; identical to SEQ ID NO: 101707
  derived and/or modified sequence opt2 from hemagglutinin__InfluenzaA__AGQ80980

SEQ ID NO: 101712 - RNA, 1683 nt, Artificial Sequence; identical to SEQ ID NO: 101692
  derived and/or modified sequence opt2 from hemagglutinin__InfluenzaA__AGQ80981

SEQ ID NO: 101713 - RNA, 1683 nt, Artificial Sequence; identical to SEQ ID NO: 101692
  derived and/or modified sequence opt2 from hemagglutinin__InfluenzaA__AGQ80982

SEQ ID NO: 101714 - RNA, 1683 nt, Artificial Sequence; identical to SEQ ID NO: 101692
  derived and/or modified sequence opt2 from hemagglutinin__InfluenzaA__AGQ80983

SEQ ID NO: 101715 - RNA, 1683 nt, Artificial Sequence; identical to SEQ ID NO: 101692
  derived and/or modified sequence opt2 from hemagglutinin__InfluenzaA__AGQ80984

SEQ ID NO: 101716 - RNA, 1683 nt, Artificial Sequence; identical to SEQ ID NO: 101692
  derived and/or modified sequence opt2 from hemagglutinin__InfluenzaA__AGQ80985

SEQ ID NO: 101717 - RNA, 1683 nt, Artificial Sequence; identical to SEQ ID NO: 101692
  derived and/or modified sequence opt2 from hemagglutinin__InfluenzaA__AGQ80986

SEQ ID NO: 101718 - RNA, 1683 nt, Artificial Sequence; identical to SEQ ID NO: 101692
  derived and/or modified sequence opt2 from hemagglutinin__InfluenzaA__AGQ80987

SEQ ID NO: 101719 - RNA, 1683 nt, Artificial Sequence; identical to SEQ ID NO: 101692
  derived and/or modified sequence opt2 from hemagglutinin__InfluenzaA__AGQ80988

SEQ ID NO: 101720 - RNA, 1683 nt, Artificial Sequence
  derived and/or modified sequence opt2 from hemagglutinin__InfluenzaA__AGQ80990
augaacacccagauccucgucuucgcccucgucgccaucauccccaccaacgccgacaagaucugccucggccaccacgccgucuccaacggcaccaaggucaacacccucaccgagcgcggcgucgaggucgucaacgccaccgagaccgucgagcgcaccuccauccccaagaucugcuccaagggcaagcgcgccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggagaccaugggcuucaccuacuccggcauccgcaccaacggcgccaccuccgccugccgccgcuccggcuccuccuucuacgccgagaugaaguggcuccucuccaacaccgacaacgccgccuucccccagaccaccaaguccuacaagaacacccgcaaggaccccgcccucaucaucuggggcauccaccacuccggcuccaccaccgagcagaccaagcucuacggcuccggcaacaagcucaucaccgucggcuccuccaacuaccagcaguccuucguccccucccccggcgcccgcccccaggucaacggccaguccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacaacggcggcaccaucaucuccaaccuccccuuccagaacaucaacucccgcgccgucggcaagugcccccgcuacgucaagcaggagucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucgaccagaucaccggcaagcucaaccgccucaucgagaagaccaaccagcaguucgagcucaucgacaacgaguucaccgaggucgagcgccagaucggcaacgucaucaacuggacccgcgacuccaugaccgaggucugguccuacaacgccgagcuccucgucgccauggagaaccagcacaccaucgaccucgccgacuccgagaugaacaagcucuacgagcgcguccgccgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgccaugggccucgucuucaucugcgucaagaacggcaacaugcgcugcaccaucugcaucuga

SEQ ID NO: 101721 - RNA, 1683 nt, Artificial Sequence; identical to SEQ ID NO: 101706
  derived and/or modified sequence opt2 from hemagglutinin__InfluenzaA__AGQ80991

SEQ ID NO: 101722 - RNA, 1683 nt, Artificial Sequence
  derived and/or modified sequence opt2 from hemagglutinin__InfluenzaA__AGQ80992
augaacacccagauccucgucuucgcccucgucgccaucauccccaccaacgccgacaagaucugccucggccaccacgccgucuccaacggcaccaaggucaacacccucaccgagcgcggcgucgaggucgucaacgccaccgagaccgucgagcgcaccaacgucccccgcaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucaugaacgaggaggcccuccgccagauccuccgcgaguccggcggcaucgacaaggagaccaugggcuucaccuacuccggcauccgcaccaacggcgccaccuccgccugccgccgcuccggcuccuccuucuacgccgagaugaaguggcuccucuccaacaccgacaacgccgccuucccccagaugaccaaguccuacaagaacacccgcaaggaccccgcccucaucaucuggggcauccaccacuccggcuccaccaccgagcagaccaagcucuacggcuccggcaacaagcucaucaccgucggcuccuccaacuaccagcaguccuucguccccucccccggcgcccgcccccaggucaacggccaguccggccgcaucgacuuccacuggcucaugcucaaccccaacgacaccgucaccuucuccuucaacggcgccuucaucgcccccgaccgcgccugcuuccuccgcggcaaguccaugggcauccaguccggcguccaggucgacgccuccugcgagggcgacugcuaccacuccggcggcaccaucaucuccaaccuccccuuccagaacaucaacucccgcgccgucggcaagugcccccgcuacgucaagcaggagucccucaugcucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucgaccagaucaccggcaagcucaaccgccucaucgagaagaccaaccagcaguucgagcucaucgacaacgaguucaccgaggucgagaagcagaucggcaacgucaucaacuggacccgcgacuccaugaccgaggucugguccuacaacgccgagcuccucgucgccauggagaaccagcacaccaucgaccucgccgacuccgagaugaacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgccaugggccucgucuucaucugcgucaagaacggcaacaugcgcugcaccaucugcaucuga

SEQ ID NO: 101723 - RNA, 1683 nt, Artificial Sequence; identical to SEQ ID NO: 101692
  derived and/or modified sequence opt2 from hemagglutinin__InfluenzaA__AGQ80993

SEQ ID NO: 101724 - RNA, 1683 nt, Artificial Sequence; identical to SEQ ID NO: 101699
  derived and/or modified sequence opt2 from hemagglutinin__InfluenzaA__AGQ80994

SEQ ID NO: 101725 - RNA, 1683 nt, Artificial Sequence; identical to SEQ ID NO: 101701
  derived and/or modified sequence opt2 from hemagglutinin__InfluenzaA__AGQ80995

SEQ ID NO: 101726 - RNA, 1683 nt, Artificial Sequence; identical to SEQ ID NO: 101701
  derived and/or modified sequence opt2 from hemagglutinin__InfluenzaA__AGQ80996

SEQ ID NO: 101727 - RNA, 1683 nt, Artificial Sequence
  derived and/or modified sequence opt2 from hemagglutinin__InfluenzaA__AGQ80997
augaacacccagauccucgucuucgcccucgucgccaucauccccaccaacgccgacaagaucugccucggccaccacgccgucuccaacggcaccaaggucaacacccucaccgagcgcggcgucgaggucgucaacgccaccgagaccgucgagcgcaccaacaucccccgcaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggagaccaugggcuucaccuacuccggcauccgcaccgacggcgccaccuccgccugccgccgcuccggcuccuccuucuacgccgagaugaaguggcuccucuccaacaccgacaacgccgccuucccccagaugaccaaguccuacaagaacacccgcaaggaccccgcccucaucaucuggggcauccaccacuccggcuccaccaccgagcagaccaagcucuacggcuccggcaacaagcucaucaccgucggcuccuccaacuaccagcaguccuucguccccucccccggcgcccgcccccaggucaacggccaguccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacuccggcggcaccaucaucuccaaccuccccuuccagaacaucaacucccgcgccgucggcaagugcccccgcuacgucaagcaggagucccuccuccucgccaccggcaugaagaacguccccgagauccccaagggccgcggccucuucggcgccaucgccggcuucaucgagaacggcugggagggccucaucgacggcugguacggcuuccgccaccagaacucccagggcgagggcaccgccgccgacuacaaguccacccaguccgccaucgaccagaucaccggcaagcucaaccgccucaucgagaagaccaaccagcaguucgagcucaucgacaacgaguucaccgaggucgagaagcagaucggcaacgucaucaacuggacccgcgacuccaugaccgaggucugguccuacaacgccgagcuccucgucgccauggagaaccagcacaccaucgaccucgccgacuccgagaugaacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgccaugggccucgucuucaucugcgucaagaacggcaacaugcgcugcaccaucugcaucuga

SEQ ID NO: 101728 - RNA, 1683 nt, Artificial Sequence
  derived and/or modified sequence opt2 from hemagglutinin__InfluenzaA__AGQ81000
augaacacccagauccucgucuucgcccucgucgccaucauccccaccaacgccgacaagaucugccucggccaccacgccgucuccaacggcaccaaggucaacacccucaccgagcgcggcgucgaggucgucaacgccaccgagaccgucgagcgcaccaacaucccccgcaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucggcaaggagaccaugggcuucaccuacuccggcauccgcaccaacggcgccaccuccgccugccgccgcuccggcuccuccuucuacgccgagaugaaguggcuccucuccaacaccgacaacgccgccuucccccagaugaccaaguccuacaagaacacccgcaaggaccccgcccucaucaucuggggcauccaccacuccggcuccaccaccgagcagaccaagcucuacggcuccggcaacaagcucaucaccgucggcuccuccaacuaccagaaguccuucguccccucccccggcgcccgcccccaggucaacggccaguccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacaacggcggcaccaucaucuccaaccuccccuuccagaacaucaacucccgcgccgucggcaagugcccccgcuacgucaagcaggagucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucgaccagaucaccggcaagcucaaccgccucaucgagaagaccaaccagcaguucgagcucaucgacaacgaguucaccgaggucgagaagcagaucggcaacgucaucaacuggacccgcgacuccaugaccgaggucugguccuacaacgccgagcuccucgucgccauggagaaccagcacaccaucgaccucgccgacuccgagaugaacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgccaugggccucgucuucaucugcgucaagaacggcaacaugcgcugcaccaucugcaucuga

SEQ ID NO: 101729 - RNA, 1683 nt, Artificial Sequence
  derived and/or modified sequence opt2 from hemagglutinin__InfluenzaA__AGQ81001
augaacacccagauccucgucuucgcccucgucgccaucauccccaccaacgccgacaagaucugccucggccaccacgccgucuccaacggcaccaaggucaacacccucaccgagcgcggcgucgaggucgucaacgccaccgagaccgucgagcgcaccaacaucccccgcaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggagaccaugggcuucaccuacuccggcauccgcaccaacggcgccaccuccgccugccgccgcuccggcuccuccuucuacgccgagaugaaguggcuccucuccaacaccgacaacgccgccuucccccagaugaccaaguccuacaagaacacccgcaaggaccccgcccucaucaucuggggcauccaccacuccggcuccaccaccgagcagaccaagcucuacggcuccggcaacaagcucaucaccgucggcaccuccaacuaccagcaguccuucguccccucccccggcgcccgcccccaggucaacggccaguccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacaacggcggcaccaucaucuccaaccuccccuuccagaacaucaacucccgcgccgucggcaagugcccccgcuacgucaagcaggagucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucgaccagaucaccggcaagcucaaccgccucaucgagaagaccaaccagcaguucgagcucaucgacaacgaguucaccgagaucgagaagcagaucggcaacgucaucaacuggacccgcgacuccaugaccgaggucugguccuacaacgccgagcuccucgucgccauggagaaccagcacaccaucgaccucgccgacuccgagaugaacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgccaugggccucgucuucaucugcgucaagaacggcaacaugcgcugcaccaucugcaucuga

SEQ ID NO: 101730 - RNA, 1683 nt, Artificial Sequence; identical to SEQ ID NO: 101707
  derived and/or modified sequence opt2 from hemagglutinin__InfluenzaA__AGQ81002

SEQ ID NO: 101731 - RNA, 1683 nt, Artificial Sequence; identical to SEQ ID NO: 101707
  derived and/or modified sequence opt2 from hemagglutinin__InfluenzaA__AGQ81003

SEQ ID NO: 101732 - RNA, 1683 nt, Artificial Sequence; identical to SEQ ID NO: 101707
  derived and/or modified sequence opt2 from hemagglutinin__InfluenzaA__AGQ81004

SEQ ID NO: 101733 - RNA, 1683 nt, Artificial Sequence; identical to SEQ ID NO: 101707
  derived and/or modified sequence opt2 from hemagglutinin__InfluenzaA__AGQ81005

SEQ ID NO: 101734 - RNA, 1683 nt, Artificial Sequence; identical to SEQ ID NO: 101707
  derived and/or modified sequence opt2 from hemagglutinin__InfluenzaA__AGQ81006

SEQ ID NO: 101735 - RNA, 1683 nt, Artificial Sequence; identical to SEQ ID NO: 101707
  derived and/or modified sequence opt2 from hemagglutinin__InfluenzaA__AGQ81007

SEQ ID NO: 101736 - RNA, 1683 nt, Artificial Sequence; identical to SEQ ID NO: 101707
  derived and/or modified sequence opt2 from hemagglutinin__InfluenzaA__AGQ81008

SEQ ID NO: 101737 - RNA, 1683 nt, Artificial Sequence
  derived and/or modified sequence opt2 from hemagglutinin__InfluenzaA__AGQ81009
augaacacccagauccucgucuucgcccucgucgccaucauccccaccaacgccgacaagaucugccucggccaccacgccgucuccaacggcaccaaggucaacacccucaccgagcgcggcgucgaggucgucaacgccaccgagaccgucgagcgcaccuccaucccccgcaucugcuccaagggcaagcgcgccgucgaccucggccagugcggccuccucggcaccaucaccggccccccccagugcgaccaguuccucgaguucuccgccgaccucaucaucgagcgccaggagggcuccgacgucugcuaccccggcaaguucgucaacgaggaggcccuccgccagauccuccgcgaguccggcggcaucaacaaggagaccaugggcuucaccuacuccggcauccgcaccaacggcgccaccuccgccugccgccgcuccggcuccuccuucuacgccgagaugaaguggcuccucuccaacaccgacaacgccgccuucccccagaccaccaaguccuacaagaacacccgcaaggaccccgcccucaucaucuggggcauccaccacuccggcuccaccaccgagcagaccaagcucuacggcuccggcaacaagcucaucaccgucggcuccuccaacuaccagcaguccuucguccccucccccggcgcccgcccccaggucaacggccaguccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacaacggcggcaccaucaucuccaaccuccccuuccagaacaucaacucccgcgccgucggcaagugcccccgcuacgucaagcaggagucccuccuccucgccaccggcaugaagaacguccccgagauccccaagggccgcggccucuucggcgccaucgccggcuucaucgagaacggcugggagggccucgucgacggcugguacggcuuccgccaccagaacgcccagggcgagggcaccgccgccgacuacaaguccacccaguccgccaucgaccagaucaccggcaagcucaaccgccucaucgagaagaccaaccagcaguucgagcucaucgacaacgaguucaccgaggucgagcgccagaucggcaacgucaucaacuggacccgcgacuccaugaccgaggucugguccuacaacgccgagcuccucgucgccauggagaaccagcacaccaucgaccucgccgacuccgagaugaacaagcucuacgagcgcguccgccgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgccaugggccucgucuucaucugcgucaagaacggcaacaugcgcugcaccaucugcaucuga

SEQ ID NO: 101738 - RNA, 1683 nt, Artificial Sequence
  derived and/or modified sequence opt2 from hemagglutinin__InfluenzaA__AGQ81011
augaacacccagauccucgucuucgcccucaucgccaucacccccaccaacuccgacaagaucugccucggccaccacgccgucuccaacggcaccaaggucaacacccucaccgagcgcggcgucgaggucgucaacgccaccgagaccgucgagcgcaccuccaucccccgcaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggaggccaugggcuucaccuacuccggcauccgcaccaacggcgccaccuccgccugccgccgcuccgaguccuccuucuacgccgagaugaaguggcuccucuccaacaccgacaacgccgccuucccccccaugaccaaguccuacaagaacacccgcaaggcccccgcccucaucaucuggggcauccaccacuccggcuccaccgccgagcagaccaagcucuacggcuccggcaacaagcucgucaccguccgcuccuccaacuaccagcaguccuucguccccucccccggcgccggccccaaggucaacggccaguccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacuccggcggcaccaucaucuccaaccuccccuuccagaacaucgacucccgcgucgucggcaagugcccccgcuacgucaagcagaagucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucaaccagaugaccggcaagcucaaccgccucaucgagaagaccaaccagcaguucgagcucaucgacaacgaguucaccgaggucgagaagcagaucggcaacgucaucaacuggacccgcgacuccaucaccgaggucugguccuacaacgccgagcuccucgucgccauggagaaccagcacaccaucgaccucgccgacuccgagaugaacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugccucauccuccucgccaucgccaugggccucgucuucaucugcgucaagaacggcaacaugcgcugcaccaucugcaucuga

SEQ ID NO: 101739 - RNA, 1683 nt, Artificial Sequence
  derived and/or modified sequence opt2 from hemagglutinin__InfluenzaA__AGQ81012
augaacacccagauccucgucuucgcccucaucgccaucauccccaccaacuccgacaagaucugccucggccaccacgccgucuccaacggcaccaaggucaacacccucaccgagcgcggcgucgaggucgucaacgccaccgagaccgucgagcgcaccuccaucccccgcaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucaacaaggaggccaugggcuucaccuacuccggcauccgcaccaacggcgccaccuccgccugccgccgcuccggcuccuccuucuacgccgagaugaaguggcuccucuccaacaccgacaacgccgccuucccccccaugaccaaguccuacaagaacacccgcaaggcccccgcccucaucaucuggggcauccaccacuccggcuccaccgccgagcagaccaagcucuacggcuccggcaacaagcucgucaccguccgcuccuccaacuaccagcaguccuucguccccucccccggcgccggcccccaggucaacggccaguccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacuccggcggcaccaucaucuccaaccuccccuuccagaacaucgacucccgcgucgucggcaagugcccccgcuacgucaagcagaagucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucaaccagaugaccggcaagcucaaccgccucaucgagaagaccaaccagcaguucgagcucaucgacaacgaguucaccgaggucgagaagcagaucggcaacgucaucaacuggacccgcgacuccaucaccgaggucugguccuacaacgccgagcuccucgucgccauggagaaccagcacaccaucgaccucgccgacuccgagaugaacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgccaugggccucgucuucaucugcgucaagaacggcaacaugcgcugcaccaucugcaucuga

SEQ ID NO: 101740 - RNA, 1683 nt, Artificial Sequence
  derived and/or modified sequence opt2 from hemagglutinin__InfluenzaA__AGQ81017
augaacacccagauccucgucuucgcccucaucgccaucacccccaccaacuccgacaagaucugccucggccaccacgccgucuccaacggcaccaaggucaacacccucaccgagcgcggcgucgaggucgucaacgccaccgagaccgucgagcgcaccuccaucccccgcaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggaggccaugggcuucaccuacuccggcauccgcaccaacggcgccaccuccgccugccgccgcuccggcuccuccuucuacgccgagaugaaguggcuccucuccaacaccgacaacgccgccuucccccccaugaccaaguccuacaagaacacccgcaaggcccccgcccucaucaucuggggcauccaccacuccggcuccaccgccgagcagaccaagcucuacggcuccggcaacaagcucgucaccguccgcuccuccaacuaccagcaguccuucguccccucccccggcgccggcccccaggucaacggccaguccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacuccggcggcaccaucaucuccaaccuccccuuccagaacaucgacucccgcgucgucggcaagugcccccgcuacgucaagcagaagucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucaaccagaugaccggcaagcucaaccgccucaucgagaagaccaaccagcaguucgagcucaucgacaacgaguucaccgaggucgagaagcagaucggcaacgucaucaacuggacccgcgacuccaucaccgaggucugguccuacaacgccgagcuccucgucgccauggagaaccagcacaccaucgaccucgccgacuccgagaugaacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgccaugggccucgucuucaucugcgucaagaacggcaacaugcgcugcaccaucugcaucuga

SEQ ID NO: 101741 - RNA, 1683 nt, Artificial Sequence
  derived and/or modified sequence opt2 from hemagglutinin__InfluenzaA__AGQ81018
augaacacccagauccucgucuucgcccucaucgccaucauccccaccaacuccgacaagaucugccucggccaccacgccgucuccaacggcaccaaggucaacacccucaccgagcgcggcgucgaggucgucaacgccaccgagaccgucgagcgcaccuccaucccccgcaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgucaaggaggccaugggcuucaccuacuccggcauccgcaccaacggcgccaccuccgccugccgccgcuccggcuccuccuucuacgccgagaugaaguggcuccucuccaacaccgacaacgccgccuucccccccaugaccaaguccuacaagaacacccgcaaggcccccgccaucaucaucuggggcauccaccacuccggcuccaccgccgagcagaccaagcucuacggcuccggcaacaagcucgucaccguccgcuccuccaacuaccagcaguccuucguccccucccccggcgccggcccccaggucaacggccaguccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacucccgcggcaccaucaucuccaaccuccccuuccagaacaucgacucccgcgucgucggcaagugcccccgcuacgucaagcagaagucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucaaccagaugaccggcaagcucaaccgccucaucgagaagaccaaccagcaguucgagcucaucgacaacgaguucaccgaggucgagaagcagaucggcaacgucaucaacuggacccgcgacuccaucaccgaggucugguccuacaacgccgagcuccucgucgccauggagaaccagcacaccaucgaccucgccgacuccgagaugaacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgccaugggccucgucuucaucugcgucaagaacggcaacaugcgcugcaccaucugcaucuga

SEQ ID NO: 101742 - RNA, 1683 nt, Artificial Sequence; identical to SEQ ID NO: 101741
  derived and/or modified sequence opt2 from hemagglutinin__InfluenzaA__AGQ81019

SEQ ID NO: 101743 - RNA, 1683 nt, Artificial Sequence; identical to SEQ ID NO: 101740
  derived and/or modified sequence opt2 from hemagglutinin__InfluenzaA__AGQ81020

SEQ ID NO: 101744 - RNA, 1683 nt, Artificial Sequence; identical to SEQ ID NO: 101741
  derived and/or modified sequence opt2 from hemagglutinin__InfluenzaA__AGQ81021

SEQ ID NO: 101745 - RNA, 1683 nt, Artificial Sequence; identical to SEQ ID NO: 101740
  derived and/or modified sequence opt2 from hemagglutinin__InfluenzaA__AGQ81022

SEQ ID NO: 101746 - RNA, 1683 nt, Artificial Sequence; identical to SEQ ID NO: 101741
  derived and/or modified sequence opt2 from hemagglutinin__InfluenzaA__AGQ81023

SEQ ID NO: 101747 - RNA, 1683 nt, Artificial Sequence
  derived and/or modified sequence opt2 from hemagglutinin__InfluenzaA__AGQ81025
augaacacccagauccucgucuucgcccucaucgccaucauccccaccaacgccgacaagaucugccucggccaccacgccgucuccaacggcaccaaggucaacacccucaccgagcgcggcgucgaggucgucaacgccaccgagaccgucgagcgcaccuccaucccccgcaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggaggccaugggcuucaccuacuccggcauccgcaccaacggcgucaccuccgccugccgccgcuccggcuccuccuucuacgccgagaugaaguggcuccucuccaacaccgacaacgccgccuucccccccaugaccaaguccuacaagaacacccgcaaggcccccgcccucaucaucuggggcauccaccacuccggcuccaccgccgagcagaccaagcucuacggcuccggcaacaagcucgucaccguccgcuccuccaacuaccagcaguccuucguccccucccccggcgccggcccccaggucaacggccaguccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacuccggcggcaccaucaucuccaaccuccccuuccagaacaucgacucccgcgucgucggcaagugcccccgcuacgucaagcagaagucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucaaccagaugaccggcaagcucaaccgccucaucgagaagaccaaccagcaguucggccucaucgacaacgaguucaccgaggucgagaagcagaucggcaacgucaucaacuggacccgcgacuccaucaccgaggucugguccuacaacgccgagcuccucgucgccauggagaaccagcacaccaucgaccucgccgacuccgagaugaacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgccaugggccucgucgucaucugcgucaagaacggcaacaugcgcugcaccaucugcaucuga

SEQ ID NO: 101748 - RNA, 1683 nt, Artificial Sequence
  derived and/or modified sequence opt2 from hemagglutinin__InfluenzaA__AGQ81026
augaacacccagauccucgucuucgcccucaucgccaucauccccaccaacgccgacaagaucugccucggccaccacgccgucuccaacggcaccaaggucaacacccucaccgagcgcggcgucgaggucgucaacgccaccgagaccgucgagcgcaccuccaucccccgcaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggaggccaugggcuucaccuacuccggcauccgcaccaacggcgccaccuccgccugccgccgcuccggcuccuccuucuacgccgagaugaaguggcuccucuccaacaccgacaacgccgccuucccccccaccaccaaguccuacaagaacacccgcaaggcccccgcccucaucaucuggggcauccaccacuccggcuccaccgccgagcagaccaagcucuacggcuccggcaacaagcucgucaccguccgcuccuccaacuaccagcaguccuucguccccucccccggcgccggcccccaggucaacggccaguccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacuccggcggcaccaucaucuccaaccuccccuuccagaacaucgacucccgcgucgucggcaagugcccccgcuacgucaagcagaagucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucaaccagaugaccggcaagcucaaccgccucaucgagaagaccaaccagcaguucgagcucaucgacaacgaguucaccgaggucgagaagcagaucggcaacgucaucaacuggacccgcgacuccaucaccgaggucugguccuacaacgccgagcuccucgucgccauggagaaccagcacaccaucgaccucgccgacuccgagaugaacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgccaugggccucgucuucaucugcgucaagaacggcaacaugcgcugcaccaucugcaucuga

SEQ ID NO: 101749 - RNA, 1683 nt, Artificial Sequence
  derived and/or modified sequence opt2 from hemagglutinin__InfluenzaA__AGQ81027
augaacacccagauccucgucuucgcccucaucgccaucauccccaccaacgccgacaagaucugccucggccaccacgccgucuccaacggcaccaaggucaacacccucaccgagcgcggcgucgaggucgucaacgccaccgagaccgucgagcgcaccuccaucccccgcaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggaggccaugggcuucaccuacuccggcauccgcaccaacggcgucaccuccgccugccgccgcuccggcuccuccuucuacgccgagaugaaguggcuccucuccaacaccgacaacgccgccuucccccccaugaccaaguccuacaagaacacccgcaaggcccccgcccucaucaucuggggcauccaccacuccggcuccaccgccgagcagaccaagcucuacggcuccggcaacaagcucgucaccguccgcuccuccaacuaccagcaguccuucguccccucccccggcgccggcccccaggucaacggccaguccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacuccggcggcaccaucaucuccaaccuccccuuccagaacaucgacucccgcgucgucggcaagugcccccgcuacgucaagcagaagucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucaaccagaugaccggcaagcucaaccgccucaucgagaagaccaaccagcaguucgagcucaucgacaacgaguucaccgaggucgagaagcagaucggcaacgucaucaacuggacccgcgacuccaucaccgaggucugguccuacaacgccgagcuccucgucgccauggagaaccagcacaccaucgaccucgccgacuccgagaugaacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgccaugggccucgucuucaucugcgucaagaacggcaacaugcgcugcaccaucugcaucuga

SEQ ID NO: 101750 - RNA, 1683 nt, Artificial Sequence
  derived and/or modified sequence opt2 from hemagglutinin__InfluenzaA__AGQ81028
augaacacccagauccucgucuucgcccucaucgccaucauccccaccaacgccgacaagaucugccucggccaccacgccgucuccaacggcaccaaggucaacacccucaccgagcgcggcgucgaggucgucaacgccaccgagaccgucgagcgcaccuccaucccccgcaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggaggccaugggcuucaccuacuccggcauccgcaccaacggcgccaccuccgccugccgccgcuccggcuccuccuucuacgccgagaugaaguggcuccucuccaacaccgacaacgccgccuucccccccaccaccaaguccuacaagaacacccgcaaggcccccgcccucaucaucuggggcauccaccacuccggcuccaccgccgagcagaccaagcucuacggcuccggcaacaagcucgucaccguccgcuccuccaacuaccagcaguccuucguccccucccccggcgccggcccccaggucaacggccaguccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacuccggcggcaccaucaucuccaaccuccccuuccagaacaucgacucccgcgucgucggcaagugcccccgcuacgucaagcagaagucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucaaccagaugaccggcaagcucaaccgccucaucgagaagaccaaccagcaguucgagcucaucgacaacgaguucaccgaggucgagaagcagaucggcaacgucaucaacuggacccgcgacuccaucaccgagaugugguccuacaacgccgagcuccucgucgccauggagaaccagcacaccaucgaccucgccgacuccgagaugaacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgccaugggccucgucuucaucugcgucaagaacggcaacaugcgcugcaccaucugcaucuga

SEQ ID NO: 101751 - RNA, 1683 nt, Artificial Sequence
  derived and/or modified sequence opt2 from hemagglutinin__InfluenzaA__AGQ81029
augaacacccagauccucgucuucgcccucaucgccaucauccccaccaacgccgacaagaucugccucggccaccacgccgucuccaacggcaccaaggucaacacccucaccgagcgcggcgucgaggucgucaacgccaccgagaccgucgagcgcaccuccaucccccgcaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggaggccaugggcuucaccuacuccggcauccgcaccaacggcgucaccuccgccugccgccgcuccggcuccuccuucuacgccgagaugaaguggcuccucuccaacaccgacaacgccgccuucccccccaugaccaaguccuacaagaacacccgcaaggcccccgcccucaucaucuggggcauccaccacuccggcuccaccgccgagcagaccaagcucuacggcuccggcaacaagcucgucaccguccgcuccuccaacuaccagcaguccuucaugcccucccccggcgccggcccccaggucaacggccaguccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacuccggcggcaccaucaucuccaaccuccccuuccagaacaucgacucccgcgucgucggcaagugcccccgcuacgucaagcagaagucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucaaccagaugaccggcaagcucaaccgccucaucgagaagaccaaccagcaguucgagcucaucgacaacgaguucaccgaggucgagaagcagaucggcaacgucaucaacuggacccgcgacuccaucaccgaggucugguccuacaacgccgagcuccucgucgccauggagaaccagcacaccaucgaccucgccgacuccgagaugaacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgccaugggccucgucuucaucugcgucaagaacggcaacaugcgcugcaccaucugcaucuga

SEQ ID NO: 101752 - RNA, 1683 nt, Artificial Sequence
  derived and/or modified sequence opt2 from hemagglutinin__InfluenzaA__AGQ81031
augaacacccagauccucgucuucgcccucaucgccaucauccccaccaacgccgacaagaucugccucggccaccacgccgucuccaacggcaccaaggucaacacccucaccgagcgcggcgucgaggucgucaacgccaccgagaccgucgagcgcaccuccaucccccgcaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucaacaaggaggccaugggcuucaccuacuccggcauccgcaccaacggcgccaccuccgccugccgccgcuccggcuccuccuucuacgccgagaugaaguggcuccucuccaacaccgacaacgccgccuucccccccaugaccaaguccuacaagaacacccgcaaggcccccgcccucaucaucuggggcauccaccacuccggcuccaccgccgagcagaccaagcucuacggcuccggcaacaagauggucaccguccgcuccuccaacuaccagcaguccuucguccccucccccggcgccggcccccaggucaacggccaguccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacuccggcggcaccaucaucuccaaccuccccuuccagaacaucgacucccgcgucgucggcaagugcccccgcuacgucaagcagaagucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucaaccagaugaccggcaagcucaaccgccucaucgagaagaccaaccagcaguucgagcucaucgacaacgaguucaccgaggucgagcgccagaucggcaacgucaucaacuggacccgcgacuccaucaccgaggucugguccuacaacgccgagcuccucgucgccauggagaaccagcacaccaucgaccucgccgacuccgagaugaacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgccaugggccucgucuucaucugcgucaagaacggcaacaugcgcugcaccaucugcaucuga

SEQ ID NO: 101753 - RNA, 1683 nt, Artificial Sequence; identical to SEQ ID NO: 101748
  derived and/or modified sequence opt2 from hemagglutinin__InfluenzaA__AGQ81032

SEQ ID NO: 101754 - RNA, 1683 nt, Artificial Sequence; identical to SEQ ID NO: 101749
  derived and/or modified sequence opt2 from hemagglutinin__InfluenzaA__AGQ81033

SEQ ID NO: 101755 - RNA, 1683 nt, Artificial Sequence; identical to SEQ ID NO: 101748
  derived and/or modified sequence opt2 from hemagglutinin__InfluenzaA__AGQ81034

SEQ ID NO: 101756 - RNA, 1683 nt, Artificial Sequence; identical to SEQ ID NO: 101749
  derived and/or modified sequence opt2 from hemagglutinin__InfluenzaA__AGQ81035

SEQ ID NO: 101757 - RNA, 1683 nt, Artificial Sequence; identical to SEQ ID NO: 101749
  derived and/or modified sequence opt2 from hemagglutinin__InfluenzaA__AGQ81036

SEQ ID NO: 101758 - RNA, 1683 nt, Artificial Sequence; identical to SEQ ID NO: 101749
  derived and/or modified sequence opt2 from hemagglutinin__InfluenzaA__AGQ81037

SEQ ID NO: 101759 - RNA, 1683 nt, Artificial Sequence; identical to SEQ ID NO: 101741
  derived and/or modified sequence opt2 from hemagglutinin__InfluenzaA__AGQ81038

SEQ ID NO: 101760 - RNA, 1683 nt, Artificial Sequence; identical to SEQ ID NO: 101741
  derived and/or modified sequence opt2 from hemagglutinin__InfluenzaA__AGQ81039

SEQ ID NO: 101761 - RNA, 1683 nt, Artificial Sequence
  derived and/or modified sequence opt2 from hemagglutinin__InfluenzaA__AGQ81040
augaacacccagauccucgucuucgcccucaucgccaucauccccaccaacgccgacaagaucugccucggccaccacgccgucuccaacggcaccaaggucaacacccucaccgagcgcggcgucgaggucgucaacgccaccgagaccgucgagcgcaccaacaucccccgcaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggaggccaugggcuucaccuacuccggcauccgcaccaacggcgccaccuccgccugccgccgcuccggcuccuccuucuacgccgagaugaaguggcuccucuccaacaccgacaacgccgccuucccccagaugaccaaguccuacaagaacacccgcaaggaccccgcccucaucaucuggggcauccaccacuccggcuccaccgccgagcagaccaagcucuacggcuccggcaacaagcucgucaccgucggcuccuccaacuaccagcaguccuucguccccucccccggcgcccgcccccaggucaacggccaguccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccagaucgacgccaacugcgagggcgacugcuaccacuccggcggcaccaucaucuccaaccuccccuuccagaacaucgacucccgcgccgucggcaagugcccccgcuacgucaagcagaagucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucgaccagaucaccggcaagcucaaccgccucaucgagaagaccaaccagcaguucgagcucaucgacaacgaguucaccgaggucgagaagcagaucggcaacgucaucaacuggacccgcgacuccaucaccgaggucugguccuacaacgccgagcuccucgucgccauggagaaccagcacaccaucgaccucgccgacuccgagaugaacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgccaugggccucgucuucaucugcgucaagaacggcaacaugcgcugcaccaucugcaucuga

SEQ ID NO: 101762 - RNA, 1683 nt, Artificial Sequence
  derived and/or modified sequence opt2 from hemagglutinin__InfluenzaA__AGQ81041
augaacacccagauccucgucuucgcccucaucgccaucauccccaccaacgccgacaagaucugccucggccaccacgccgucuccaacggcaccaaggucaacacccucaccgagcgcggcgucgaggucgucaacgccaccgagaccgucgagcgcaccaacaucccccgcaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggaggccaugggcuucaccuacuccggcauccgcaccaacggcgccaccuccgccugccgccgcuccggcuccuccuucuacgccgagaugaaguggcuccucuccaacaccgacaacgccgccuucccccagaccaccaaguccuacaagaacacccgcaaggaccccgcccucaucaucuggggcauccaccacuccggcuccaccgccgagcagaccaagcucuacggcuccggcaacaagcucgucaccgucggcuccuccaacuaccagcaguccuucguccccucccccggcgcccgcccccaggucaacggccaguccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacuccggcggcaccaucaucuccaaccuccccuuccagaacaucgacucccgcgccgucggcaagugcccccgcuacgucaagcagaagucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucgaccagaucaccggcaagcucaaccgccucaucgagaagaccaaccagcaguucgagcucaucgacaacgaguucaccgaggucgagaagcagaucggcaacgucaucaacuggacccgcgacuccaucaccgaggucugguccuacaacgccgagcuccucgucgccauggagaaccagcacaccaucgaccucgccgacuccgagaugaacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgccaugggccucgucuucaucugcgucaagaacggcaacaugcgcugcaccaucugcaucuga

SEQ ID NO: 101763 - RNA, 1683 nt, Artificial Sequence
  derived and/or modified sequence opt2 from hemagglutinin__InfluenzaA__AGQ81042
augaacacccagauccucgucuucgcccucaucgccaucauccccaccaacgccgacaagaucugccucggccaccacgccgucuccaacggcaccaaggucaacacccucaccgagcgcggcgucgaggucgucaacgccaccgagaccgucgagcgcaccaacaucccccgcaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggaggccaugggcuucaccuacuccggcauccgcaccaacggcgccaccuccgccugccgccgcuccggcuccuccuucuacgccgagaugaaguggcuccucuccaacaccgacaacgccgccuucccccagaugaccaaguccuacaagaacacccgcaaggaccccgcccucaucaucuggggcauccaccacuccggcuccaccgccgagcagaccaagcucuacggcuccggcaacaagcucgucaccgucggcuccuccaacuaccagcaguccuucguccccucccccggcgcccgcccccaggucaacggccaguccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacuccggcggcaccaucaucuccaaccuccccuuccagaacaucgacucccgcgccgucggcaagugcccccgcuacgucaagcagaagucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucgaccagaucaccggcaagcucaaccgccucaucgagaagaccaaccagcaguucgagcucaucgacaacgaguucaccgaggucgagaagcagaucggcaacgucaucaacuggacccgcgacuccaucaccgaggucugguccuacaacgccgagcuccucgucgccauggagaaccagcacaccaucgaccucgccgacuccgagaugaacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgccaugggccucgucuucaucugcgucaagaacggcaacaugcgcugcaccaucugcaucuga

SEQ ID NO: 101764 - RNA, 1683 nt, Artificial Sequence
  derived and/or modified sequence opt2 from hemagglutinin__InfluenzaA__AGQ81043
augaacacccagauccucgucuucgcccucaucgccaucauccccaccaacgccgacaagaucugccucggccaccacgccgucuccaacggcaccaaggucaacacccucaccgagcgcggcgucgaggucgucaacgccaccgagaccgucgagcgcaccaacaucccccgcaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggaggagaugggcuucaccuacuccggcauccgcaccaacggcgccaccuccgccugccgccgcuccggcuccuccuucuacgccgagaugaaguggcuccucuccaacaccgacaacgccgccuucccccagaugaccaaguccuacaagaacacccgcaagucccccgcccucaucgucuggggcauccaccacuccgucuccaccgccgagcagaccaagcucuacggcuccggcaacaagcucgucaccgucggcuccuccaacuaccagcaguccuucguccccucccccggcgcccgcccccaggucaacggccucuccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacuccggcggcaccaucaucuccaaccuccccuuccagaacaucgacucccgcgccgucggcaagugcccccgcuacgucaagcagcgcucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucgaccagaucaccggcaagcucaaccgccucaucgagaagaccaaccagcaguucgagcucaucgacaacgaguucaacgaggucgagaagcagaucggcaacgucaucaacuggacccgcgacuccaucaccgaggucugguccuacaacgccgagcuccucgucgccauggagaaccagcacaccaucgaccucgccgacuccgagauggacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgucaugggccucgucuucaucugcgucaagaacggcaacaugcgcugcaccaucugcaucuga

SEQ ID NO: 101765 - RNA, 1683 nt, Artificial Sequence; identical to SEQ ID NO: 101500
  derived and/or modified sequence opt2 from hemagglutinin__InfluenzaA__AGQ81044

SEQ ID NO: 101766 - RNA, 1683 nt, Artificial Sequence; identical to SEQ ID NO: 101500
  derived and/or modified sequence opt2 from hemagglutinin__InfluenzaA__AGQ81045

SEQ ID NO: 101767 - RNA, 1683 nt, Artificial Sequence; identical to SEQ ID NO: 101500
  derived and/or modified sequence opt2 from hemagglutinin__InfluenzaA__AGQ81046

SEQ ID NO: 101768 - RNA, 1683 nt, Artificial Sequence; identical to SEQ ID NO: 101749
  derived and/or modified sequence opt2 from hemagglutinin__InfluenzaA__AGQ81047

SEQ ID NO: 101769 - RNA, 1683 nt, Artificial Sequence; identical to SEQ ID NO: 101748
  derived and/or modified sequence opt2 from hemagglutinin__InfluenzaA__AGQ81049

SEQ ID NO: 101770 - RNA, 1683 nt, Artificial Sequence; identical to SEQ ID NO: 101749
  derived and/or modified sequence opt2 from hemagglutinin__InfluenzaA__AGQ81050

SEQ ID NO: 101771 - RNA, 1683 nt, Artificial Sequence
  derived and/or modified sequence opt2 from hemagglutinin__InfluenzaA__AGQ81051
augaacacccagauccucgucuucgcccucaucgccaucauccccaccaacgccgacaagaucugccucggccaccacgccgucuccaacggcaccaaggucaacacccucaccgagcgcggcgucgaggucgucaacgccaccgagaccgucgagcgcaccuccaucccccgcaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucaacaaggaggccaugggcuucaccuacuccggcauccgcaccaacggcgccaccuccgccugccgccgcuccggcuccuccuucuacgccgagaugaaguggcuccucuccaacaccgacaacgccgccuucccccccaugaccaaguccuacaagaacacccgcaaggcccccgcccucaucaucuggggcauccaccacuccggcuccaccgccgagcagaccaagcucuacggcuccggcaacaagcucgucaccguccgcuccuccaacuaccagcaguccuucguccccucccccggcgccggcccccaggucaacggccaguccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacuccggcggcaccaucaucuccaaccuccccuuccagaacaucgacucccgcgucgucggcaagugcccccgcuacgucaagcagaagucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucaaccagaugaccggcaagcucaaccgccucaucgagaagaccaaccagcaguucgagcucaucgacaacgaguucaccgaggucgagaagcagaucggcaacgucaucaacuggacccgcgacuccaucaccgaggucugguccuacaacgccgagcuccucgucgccauggagaaccagcacaccaucgaccucgccgacuccgagaugaacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgccaugggccucgucuucaucugcgucaagaacggcaacaugcgcugcaccaucugcaucuga

SEQ ID NO: 101772 - RNA, 1683 nt, Artificial Sequence; identical to SEQ ID NO: 101749
  derived and/or modified sequence opt2 from hemagglutinin__InfluenzaA__AGQ81052

SEQ ID NO: 101773 - RNA, 1683 nt, Artificial Sequence
  derived and/or modified sequence opt2 from hemagglutinin__InfluenzaA__AGQ81053
augaacacccagauccucgucuucgcccucaucgccaucauccccaccaacgccgacaagaucugccucggccaccacgccgucuccaacggcaccaaggucaacacccucaccgagcgcggcgucgaggucgucaacgccaccgagaccgucgagcgcaccuccaucccccgcaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucaacaaggaggccaugggcuucaccuacuccggcauccgcaccaacggcgccaccuccgccugccgccgcuccggcuccuccuucuacgccgagaugaaguggcuccucuccaacaccgacaacgccgccuucccccccaugaccaaguccuacaagaacacccgcaaggcccccgcccucaucaucuggggcauccaccacuccggcuccaccgccgagcagaccaagcucuacggcuccggcaacaagauggucaccguccgcuccuccaacuaccagcaguccuucguccccucccccggcgccggcccccaggucaacggccaguccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacuccggcggcaccaucaucuccaaccuccccuuccagaacaucgacucccgcgucgucggcaagugcccccgcuacgucaagcagaagucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucaaccagaugaccggcaagcucaaccgccucaucgagaagaccaaccagcaguucgagcucaucgacaacgaguucaccgaggucgagaagcagaucggcaacgucaucaacuggacccgcgacuccaucaccgaggucugguccuacaacgccgagcuccucgucgccauggagaaccagcacaccaucgaccucgccgacuccgagaugaacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcaaggaggccaugcagaaccgcauccagaucgaccccgucaagcucuccuccggcuacaaggacgucauccucugguucuccuucggcgccuccugcuucauccuccucgccaucgccaugggccucgucuucaucugcgucaagaacggcaacaugcgcugcaccaucugcaucuga

SEQ ID NO: 101774 - RNA, 1683 nt, Artificial Sequence; identical to SEQ ID NO: 101749
  derived and/or modified sequence opt2 from hemagglutinin__InfluenzaA__AGQ81055

SEQ ID NO: 101775 - RNA, 1683 nt, Artificial Sequence; identical to SEQ ID NO: 101749
  derived and/or modified sequence opt2 from hemagglutinin__InfluenzaA__AGQ81056

SEQ ID NO: 101776 - RNA, 1683 nt, Artificial Sequence; identical to SEQ ID NO: 101749
  derived and/or modified sequence opt2 from hemagglutinin__InfluenzaA__AGQ81057

SEQ ID NO: 101777 - RNA, 1683 nt, Artificial Sequence; identical to SEQ ID NO: 101749
  derived and/or modified sequence opt2 from hemagglutinin__InfluenzaA__AGQ81058

SEQ ID NO: 101778 - RNA, 1683 nt, Artificial Sequence; identical to SEQ ID NO: 101500
  derived and/or modified sequence opt2 from hemagglutinin__InfluenzaA__AGQ81059

SEQ ID NO: 101779 - RNA, 1683 nt, Artificial Sequence; identical to SEQ ID NO: 101500
  derived and/or modified sequence opt2 from hemagglutinin__InfluenzaA__AGQ81060

SEQ ID NO: 101780 - RNA, 1683 nt, Artificial Sequence; identical to SEQ ID NO: 101500
  derived and/or modified sequence opt2 from hemagglutinin__InfluenzaA__AGQ81061

SEQ ID NO: 101781 - RNA, 1683 nt, Artificial Sequence
  derived and/or modified sequence opt2 from hemagglutinin__InfluenzaA__AGQ81081
auggaggucgucucccucaucaccauccuccucgucaucaccggcuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccaaccucggccgcccccucauccucgacaccugcaccaucgagggccucaucuacggcaaccccuccugcgacauccuccucggcggccgcgagugguccuacaucgucgagcgccccuccgccgucaacggccucugcuaccccggcaacgucgagaaccucgaggagcuccgcucccucuucuccuccgccuccuccuaccagcgcauccagaucuuccccgacaccaucuggaacgucuccuacuccggcaccuccaaggccugcuccgacuccuucuaccgcuccaugcgcuggcucacccagaagaacaacgccuaccccguccaggacgcccaguacaccaacaaccgcggccgcaacauccucuucauguggggcaucaaccacccccccaccgacaccgcccagaccaaccucuacacccgcaccgacaccaccaccuccgucgccaccgaggacaucaaccgcaccuucaagccccucaucggcccccgcccccucgucaacggccuccagggccgcaucgacuacuacugggccguccuccgccccggccagacccuccgcauccgcuccaacggcaaccucaucgcccccugguacggccacauccucuccggcgagucccacggccgcauccucaagaccgaccucaacuccggcaacugcgucguccagugccagaccgagcgcggcggccucaacaccacccuccccuuccacaacgucuccaaguacgccuucggcaacugccccaaguacgucggcgucaagucccucaagcucgccgucggccuccgcaacguccccgcccgcuccucccgcggccucuucggcgccaucgccggcuucaucgagggcggcugguccggccucgucgccggcugguacggcuuccagcacuccaacgaccagggcaccggcauggccgccgaccgcgacuccacccagaaggccaucgacaagaucaccuccaaggucaacaacaucgucgacaagaugaacaagcaguacgagaucaucgaccacgaguucuccgagaucgagacccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgagcucuaccacaagugcgacaaccagugcauggagaccauccgcaacggcaccuacaaccgccgcaaguacaaggaggagucccgccucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 101782 - RNA, 1683 nt, Artificial Sequence
  derived and/or modified sequence opt2 from hemagglutinin__InfluenzaA__AGQ81086
auggaggucgucucccucaucaccauccuccucgucaucaccggcuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccaaccucggccgcccccucauccucgacaccugcaccaucgagggccucaucuacggcaaccccuccugcgaccuccuccucggcggccgcgagugguccuacaucgucgagcgccccuccgccgucaacggccucugcuaccccggcaacgucgagaaccucgaggagcuccgcucccucuucuccuccgccuccuccuaccagcgcauccagaucuuccccgacaccaucuggaacgucuccuacuccggcaccuccaaggccugcuccgacuccuucuaccgcuccaugcgcuggcucacccagaagaacaacgccuaccccguccaggacgcccaguacaccaacaaccgcggccgcaacauccucuucauguggggcaucaaccacccccccaccgacaccgcccagaccaaccucuacacccgcaccgacaccaccaccuccgucgccaccgaggacaucaaccgcaccuucaagccccucaucggcccccgcccccucgucaacggccuccagggccgcaucgacuacuacugggccguccuccgccccggccagacccuccgcauccgcuccaacggcaaccucaucgcccccugguacggccacauccucuccggcgagucccacggccgcauccucaagaccgaccucaacuccggcaacugcgucguccagugccagaccgagcgcggcggccucaacaccacccuccccuuccacaacgucuccaaguacgccuucggcaacugccccaaguacgucggcgucaagucccucaagcucgccgucggccuccgcaacguccccgcccgcuccucccgcggccucuucggcgccaucgccggcuucaucgagggcggcugguccggccucgucgccggcugguacggcuuccagcacuccaacgaccagggcaccggcauggccgccgaccgcgacuccacccagaaggccaucgacaagaucaccuccaaggucaacaacaucgucgacaagaugaacaagcaguacgagaucaucgaccacgaguucuccgagaucgagacccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgagcucuaccacaagugcgacaaccagugcauggagaccauccgcaacggcaccuacaaccgccgcaaguacaaggaggagucccgccucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 101783 - RNA, 1683 nt, Artificial Sequence
  derived and/or modified sequence opt2 from hemagglutinin__InfluenzaA__AGQ81087
auggagaccgucucccucaucaccaugcuccucgucgccaccgucaucaacgccgacaagaucugcaucggcuaccaguccaccaacuccaccgagaccgucgacacccucaccgagaacaacguccccgucacccacgccaaggagcuccuccacaccgagcacaacggcaugcucugcgccaccaaccucggccacccccucauccucgacaccugcaccaucgagggccucaucuacggcaaccccuccugcgaccuccuccucggcggccgcgagugguccuacaucgucgagcgccccuccgccgucaacggccucugcuaccccggcaacgucgagaaccucgaggagcuccgcucccucuucuccuccgccuccuccuaccagcgcauccagaucuuccccgacaccaucuggaacgucuccuacuccggcaccuccaaggccugcuccgacuccuucuaccgcuccaugcgcuggcucacccagaagaacaacgccuaccccauccaggacgcccaguacaccaacaaccgcgagaagaacauccucuucauguggggcaucaaccacccccccaccgacaccgcccagaccaaccucuacacccgcaccgacaccaccaccuccgucgccaccgaggagaucaaccgcaccuucaagccccucaucggcccccgcccccucgucaacggccuccagggccgcaucgacuacuacugguccguccucaagcccggccagacccuccgcauccgcuccaacggcaaccucaucgcccccugguacggccacauccucuccggcgagucccacggccgcguccucaagaccgaccucaagcgcggcuccugcaccguccagugccagaccgagaagggcggccucaacaccacccuccccuuccagaacgucuccaaguacgccuucggcaacugcuccaaguacgucggcgucaagucccucaagcucgccgucggccuccgcaacguccccucccgcuccucccgcggccucuucggcgccaucgccggcuucaucgagggcggcugguccggccucgucgccggcugguacggcuuccagcacuccaacgaccagggcgucggcauggccgccgaccgcgacuccacccagaaggccaucgacaagaugaccuccaaggucaacaacaucgucgacaagaugaacaagcaguacgagaucaucaaccacgaguucuccgagaucgagacccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgagcucuaccacaagugcgacgaccagugcauggagaccauccgcaacggcaccuacaaccgccgccgcuaccaggaggaguccaagcucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 101784 - RNA, 1683 nt, Artificial Sequence
  derived and/or modified sequence opt2 from hemagglutinin__InfluenzaA__AGQ81092
auggaggucgucucccucaucaccauccuccucgucaucaccggcuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccaaccucggccgcccccucauccucgacaccugcaccaucgagggccucaucuacggcaaccccuccugcgaccuccuccucggcggccgcgagugguccuacaucgucgagcgccccuccgccgucaacggccucugcuaccccggcaacgucgagaaccucgaggagcuccgcucccucuucuccuccgccuccuccuaccagcgcauccagaucuuccccgacaccaucuggaacgucuccuacaccggcaccuccaaggccugcuccgacuccuucuaccgcuccaugcgcuggcucacccagaagaacaacgccuaccccguccaggacgcccaguacaccaacaaccgcggccgcaacauccucuucauguggggcaucaaccacccccccaccgacaccacccagaccaaccucuacacccgcaccgacaccaccaccuccgucgccaccgaggacaucaaccgcaccuucaagccccucaucggcccccgcccccucgucaacggccuccagggccgcaucgacuacuacugggccguccuccgccccggccagacccuccgcauccgcuccaacggcaaccucaucgcccccugguacggccacauccucuccggcgagucccacggccgcauccucaagaccgaccucaaguccggcaacugcgucguccagugccagaccgagcgcggcggccucaacaccacccuccccuuccacaacgucuccaaguacgccuucggcaacugccccaaguacgucggcgucaagucccucaagcucgccgucggccuccgcaacguccccgcccgcuccucccgcggccucuucggcgccaucgccggcuucaucgagggcggcugguccggccucgucgccggcugguacggcuuccagcacuccaacgaccagggcaccggcauggccgccgaccgcgacuccacccagaaggccaucgacaagaucaccuccaaggucaacaacaucgucgacaagaugaacaagcaguacgagaucaucgaccacgaguucuccgagaucgagacccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgagcucuaccacaagugcgacaaccagugcauggagaccauccgcaacggcaccuacaaccgccgcaaguacaaggaggagucccgccucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 101785 - RNA, 1683 nt, Artificial Sequence
  derived and/or modified sequence opt2 from hemagglutinin__InfluenzaA__AGQ81095
auggaggucgucucccucaucaccauccuccucgucaucaccgucuccaacgccgacaagaucugcaucggcuaccaguccaccaacuccaccgagaccgucaacacccucaccgaggacaacguccccgucacccacgccaaggagcuccuccacaccgagcacaacggcaugcucugcgccaccaaccucggccgcccccucauccucgacaccugcaccaucgagggccucaucuacggcaaccccuccugcgaccuccuccucggcggccgcgagugguccuacaucgucgagcgccccuccgccgucaacggccucugcuaccccggcaacgucgagaaccucgaggagcuccgcucccucuucuccuccgccuccuccuaccagcgcauccagaucuuccccgacaccaucuggaacgucuccuacuccggcaccuccaaggccugcuccgacuccuucuaccgcuccaugcgcuggcucacccagaagaacaacgccuaccccguccaggacgcccaguacaccaacaaccgcggccgcaacauccucuucauguggggcaucaaccacccccccaccgacaccgcccagaccaaccucuacacccgcaccgacaccaccaccuccgucgccaccgaggacaucaaccgcaccuucaagccccucaucggcccccgcccccucgucaacggccuccagggccgcaucgacuacuacugggccguccucaagcccggccagacccuccgcauccgcuccaacggcaaccucaucgcccccugguacggccacauccucuccggcgagucccacggccgcauccucaagaccgaccucaacuccggcaacugcgucguccagugccaguccgagcgcggcggccucaacaccacccuccccuuccacaacgucuccaaguacgccuucggcaacugccccaaguacgucggcgucaagucccucaagcucgccgucggccuccgcaacguccccgcccgcuccucccgcggccucuucggcgccaucgccggcuucaucgagggcggcugguccggccucgucgccggcugguacggcuuccagcacuccaacgaccagggcaccggcauggccgccgaccgcgacuccacccagaaggccaucgacaagaucaccuccaaggucaacaacaucgucgacaagaugaacaagcaguacgagaucaucgaccacgaguucuccgagaucgagacccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgagcucuaccacaagugcgacaaccagugcauggagaccauccgcaacggcaccuacgaccgccgcaaguacaaggaggagucccgccucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgccgcaacaucugcaucuga

SEQ ID NO: 101786 - RNA, 1683 nt, Artificial Sequence
  derived and/or modified sequence opt2 from hemagglutinin__InfluenzaA__AGQ81099
auggagaccgucucccucaucaccauccuccucaucgucaccgucuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccaaccucggccacccccucauccucgacaccugcaccaucgagggccucaucuacggcaaccccuccugcgaccuccuccucggcggccgcgagugguccuacaucgucgagcgccccuccgccgucaacggccucugcuaccccggcaacgucgagaaccucgaggagcuccgcucccucuucuccuccgccaacuccuaccagcgcauccagaucuuccccgacaccaucuggaacgucuccuacuccggcaccuccaaggccugcuccgacuccuucuaccgcuccaugcgcuggcucacccagaagaacaacgccuaccccacccaggacgcccaguacaccaacaaccgcgagaagaacauccucuucauguggggcaucaaccacccccccaccgacaccgcccagaccaaccucuacacccgcaccgacaccaccaccuccgucgccaccgaggagaucaaccgcaccuucaagccccucaucggcccccgcccccucgucaacggccuccagggccgcaucgacuacuacugguccguccucaagcccggccagacccuccgcauccgcuccaacggcaaccucaucgcccccugguacggccacauccucuccggcgagucccacggccgcauccucaagaccgaccucaagcgcggcuccugcaccguccagugccagaccgagaagggcggccucaacaccacccuccccuuccagaacgucuccaaguacgccuucggcaacugcuccaaguacgucggcgucaagucccucaagcucgccgucggccuccgcaacguccccucccgcuccucccgcggccucuucggcgccaucgccggcuucaucgagggcggcugguccggccucgucgccggcugguacggcuuccagcacuccaacgaccagggcgucggcauggccgccgaccgcgacuccacccagaaggccaucgacaaggucaccuccaaggucaacaacaucgucgacaagaugaacaagcaguacgagaucaucgaccacgaguucuccgaggucgagacccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgagcucuaccacaagugcgacgaccagugcauggagaccauccgcaacggcaccuacaaccgccgcaaguaccaggaggaguccaagcucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgccgcaacaucugcaucuga

SEQ ID NO: 101787 - RNA, 1683 nt, Artificial Sequence
  derived and/or modified sequence opt2 from hemagglutinin__InfluenzaA__AGQ81100
auggagaccgucucccucaucaccaugcuccucgucgccaccgucaucaacgccgacaagaucugcaucggcuaccaguccaccaacuccaccgagaccgucgacacccucaccgagaacaacguccccgucacccacgccaaggagcuccuccacaccgagcacaacggcaugcucugcgccaccaaccucggccacccccucauccucgacaccugcaccaucgagggccucaucuacggcaaccccuccugcgaccuccuccucggcggccgcgagugguccuacaucgucgagcgccccuccgccgucaacggccucugcuaccccggcaacgucgagaaccucgaggagcuccgcucccucuucuccuccgccuccuccuaccagcgcauccagaucuuccccgacaccaucuggaacgucuccuacuccggcaccuccaaggccugcuccgacuccuucuaccgcuccaugcgcuggcucacccagaagaacaacgccuaccccauccaggacgcccaguacaccaacaaccgcgagaagaacauccucuucauguggggcaucaaccacccccccaccgacaccgcccagaccaaccucuacacccgcaccgacaccaccaccuccgucgccaccgaggagaucaaccgcaccuucaagccccucaucggcccccgcccccucgucaacggccuccagggccgcaucgacuacuacugguccguccucaagcccggccagacccuccgcauccgcuccaacggcaaccucaucgcccccugguacggccacauccucuccggcgagucccacggccgcauccucaagaccgaccucaagcgcggcuccugcaccguccagugccagaccgagaagggcggccucaacaccacccuccccuuccagaacgucuccaaguacgccuucggcaacugcuccaaguacgucggcgucaagucccucaagcucgccgucggccuccgcaacguccccucccgcuccucccgcggccucuucggcgccaucgccggcuucaucgagggcggcugguccggccucgucgccggcugguacggcuuccagcacuccaacgaccagggcgucggcauggccgccgaccgcgacuccacccagaaggccaucgacaagaucaccuccaaggucaacaacaucgucgacaagaugaacaagcaguacgagaucaucgaccacgaguucuccgaggucgagacccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgagcucuaccacaagugcgacgaccagugcauggagaccauccgcaacggcaccuacaaccgccgccgcuaccaggaggaguccaagcucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgccgcaacaucugcaucuga

SEQ ID NO: 101788 - RNA, 1683 nt, Artificial Sequence
  derived and/or modified sequence opt2 from hemagglutinin__InfluenzaA__AGQ81123
auggaggucgucucccucaucaccauccuccucgucaucaccgucuccaacgccgacaagaucugcaucggcuaccaguccaccaacuccaccgagaccgucaacacccucaccgaggacaacguccccgucacccacgccaaggagcuccuccacaccgagcacaacggcaugcucugcgccaccaaccucggccgcccccucauccucgacaccugcaccaucgagggccucaucuacggcaaccccuccugcgaccuccuccucggcggccgcgagugguccuacaucgucgagcgccccuccgccgucaacggccucugcuaccccggcaacgucgagaaccucgaggagcuccgcucccucuucuccuccgccuccuccuaccagcgcauccagaucuuccccgacaccaucuggaacgucuccuacuccggcaccuccaaggccugcuccgacuccuucuaccgcuccaugcgcuggcucacccagaagaacaacgccuaccccguccaggacgcccaguacaccaacaacaagggccgcaacauccucuucauguggggcaucaaccacccccccaccgacaccgcccagaccaaccucuacacccgcaccgacaccaccaccuccgucgccaccgaggacaucaaccgcaccuucaagccccucaucggcccccgcccccucgucaacggccuccagggccgcaucgacuacuacugggccguccucaagcccggccagacccuccgcauccgcuccaacggcaaccucaucgcccccugguacggccacauccuccucggcgagucccacggccgcauccucaagaccgaccucaacuccggcgacugcgucguccagugccaguccgagcgcggcggccucaacaccacccuccccuuccacaacgucuccaaguacgccuucggcaacugccccaaguacgucggcgucaagucccucaagcucgccgucggccuccgcaacguccccgcccgcuccacccgcggccucuucggcgccaucgccggcuucaucgagggcggcugguccggccucgucgccggcugguacggcuuccagcacuccaacgaccagggcaccggcauggccgccgaccgcgacuccacccagaaggccaucgacaagaucaccuccaaggucaacaacaucgucgacaagaugaacaagcaguacgagaucaucgaccacgaguucuccgagaucgagacccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgagcucuaccacaagugcgacaaccagugcauggagaccauccgcaacggcaccuacgaccgccgcaaguacaaggaggagucccgccucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 101789 - RNA, 1683 nt, Artificial Sequence
  derived and/or modified sequence opt2 from hemagglutinin__InfluenzaA__AGQ81124
auggaggucgccacccucaucaccauccuccucgucaucaccggcuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccaaccucggccgcccccucauccucgacaccugcaccaucgagggccucaucuacggcaaccccuccugcgaccucccccucgagggccgcgagugguccuacaucgucgagcgccccuccgccgucaacggcgucugcuaccccggcaacgucgagaaccucgaggagcuccgcucccucuucuccuccgccuccuccuaccagcgcauccagaucuuccccgacuccaucuggaacgucuccuacuccggcaccuccaaggccugcuccgacuccuucuaccgcaacaugcgcuggcucacccagaaggacaacaacuaccccguccaggacgcccaguacaccaacaaccgcggcaagaacauccucuucauguggggcaucaaccacccccccaccgacaccgcccagaccaaccucuacacccgcaccgacaccaccaccuccgucgccaccgaggacaucaaccgcaccuucaagccccucaucggcccccgcccccucgucaacggccuccagggccgcaucgacuacuacugggccguccucaagcccggccagacccuccgcguccgcuccaacggcaaccucaucgcccccugguacggccacauccuccucggcgagucccacggccgcauccucaagaccgaccucaaguccggcaacugcgucguccagugccagaccgagcgcggcggccucaacaccacccuccccuuccacaacgucuccaaguacgccuucggcaacugccccaaguacaucggcgucaagucccucaagcucgccgucggccuccgcaacguccccgcccgcuccucccgcggccucuucggcgccaucgccggcuucaucgagggcggcugguccggccucgucgccggcugguacggcuuccagcacuccaacgaccagggcaccggcauggccgccgaccgcgacuccacccagaaggccaucgacaagaucaccuccaaggucaacaacaucgucgacaagaugaacaagcaguacgagaucaucgaccacgaguucuccgagaucgagacccgccucaacaugaucaacgacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgaccucuaccacaagugcgacaaccagugcauggagaccauccgcaacggcaccuacaaccgccgcaaguaccagaaggagucccgccucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 101790 - RNA, 1683 nt, Artificial Sequence
  derived and/or modified sequence opt2 from hemagglutinin__InfluenzaA__AGQ81125
auggaggucgccacccucaucaccauccuccucgucaucaccggcuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccaaccucggccgcccccucauccucgacaccugcaccaucgagggccucaucuacggcaaccccuccugcgaccucccccucgagggccgcgagugguccuacaucgucgagcgccccuccgccgucaacggcgucugcuaccccggcaacgucgagaaccucgaggagcuccgcucccucuucuccuccgccuccuccuaccagcgcauccagaucuuccccgacuccaucuggaacgucuccuacuccggcaccuccaaggccugcuccgacuccuucuaccgcuccaugcgcuggcucacccagaaggacaacaacuaccccguccaggacgcccaguacaccaacaaccgcggcaagaacauccucuucauguggggcaucaaccacccccccaccgacaccgcccagaccaaccucuacacccgcaccgacaccaccaccuccgucgccaccgaggacaucaaccgcaccuucaagccccucaucggcccccgcccccucgucaacggccuccagggccgcaucgacuacuacugggccguccucaagcccggccagacccuccgcguccgcuccaacggcaaccucaucgcccccugguacggccacauccuccucggcgucucccacggccgcauccucaagaccgaccucaaguccggcaacugcgucguccagugccagaccgagcgcggcggccucaacaccacccuccccuuccacaacgucuccaaguacgccuucggcaacugccccaaguacaucggcgucaagucccucaagcucgccgucggccuccgcaacguccccgcccgcuccucccgcggccucuucggcgccaucgccggcuucaucgagggcggcugguccggccucgucgccggcugguacggcuuccagcacuccaacgaccagggcaccggcauggccgccgaccgcgacuccacccagaaggccaucgacaagaucaccuccaaggucaacaacaucgucgacaagaugaacaagcaguacgagaucaucgaccacgaguucuccgagaucgagacccgccucaacaugaucaacgacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgaccucuaccacaagugcgacaaccagugcauggagaccauccgcaacggcaccuacaaccgccgcaaguaccaggaggagucccgccucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 101791 - RNA, 1683 nt, Artificial Sequence
  derived and/or modified sequence opt2 from hemagglutinin__InfluenzaA__AGQ81126
auggagaccaucucccucaugaccauccuccucaucaccaccgccuccaacgccgacaagaucugcaucggccaccaguccaccaacuccaccgagaccgucgacacccucaccgagaccaacguccccgucacccacgccaaggagcuccuccagaccgagcacaacggcaugcucugcgccaccaaccucggccacccccucauccucgacaccugcaccaucgagggccucaucuacggcaaccccuccugcgaccuccuccucgagggccgcgagugguccuacaucgucgagcgccccuccgccgucaacggcaccugcuaccccggcaacgucgagaaccucgaggagcuccgcacccucuucuccuccgccuccuccuaccagcgcauccagaucuuccccgacaccaucuggaacgucaccuacaccggcaccucccgcuccugcuccggcuccuucuaccgcuccaugcgcuggcucacccagaaguccggcuucuaccccguccaggacgccaaguacaccaacaaccgcggcaagaacauccucuucgucuggggcauccaccacccccacaccuacaccgaccagaccacccucuacauccgcaacgacaccaccaccuccgucaccaccgaggagcucaaccgcaucuucaagcccgucaucgucccccgccuccucgucaacggccagcagggccgcaucgacuacuacugguccguccucaagcccggccagacccuccgcguccgcuccaacggcaaccucaucgcccccugguacggccacguccucuccggcggcucccacggccgcauccucaagaccgaccucaagggcggcaacugcgucguccagugccagaccgagaagggcggcuucaacuccacccuccccuuccacaacaucuccaaguacgccuucggcaccugccccaaguacgucaaggucaacucccucaagcucgccaucggccuccgcaacguccccgcccgcuccaaccgcggccucuucggcgccaucgccggcuucaucgagggcggcuggcccggccucgucgccggcugguacggcuuccagcacuccaacgaccagggcgucggcauggccgccgaccgcgacuccacccagaaggccgucgacaagaucaccuccaaggucaacaacaucgucgacaagaugaacaagcaguacgagaucaucgaccacgaguucuccgaggucgagacccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccauggaggacggcaagggcugcuucgagcucuaccacaagugcgacgaccagugcauggagaccauccgcaacggcaccuacaaccgccgcaaguaccgcgaggagucccgccucgagcagcagcgcaucgagggcgucaagcucgaguccgagggcaccuacaagauccucaccaucuacuccaccgucgccuccucccucguccucgccaugggcuucgccgccuuccucuucugggccauguccaacggcuccugccgcugcaacaucugcaucuga

SEQ ID NO: 101792 - RNA, 1683 nt, Artificial Sequence
  derived and/or modified sequence opt2 from hemagglutinin__InfluenzaA__AGQ81127
auggaggucgccacccucaucaccauccuccuccucaucaccggcuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccaaccucggccgcccccucauccucgacaccugcaccaucgagggccucaucuacggcaaccccuccugcgaccucccccucgagggccgcgagugguccuacaucgucgagcgccccuccgccgucaacggcgucugcuaccccggcaacgucgagaaccucgaggagcuccgcucccucuucuccuccgccuccuccuaccagcgcauccagaucuuccccgacuccaucuggaacgucuccuacuccggcaccuccaaggccugcuccgacuccuucuaccgcuccaugcgcuggcucacccagaagaacaacaacuaccccguccaggacgcccaguacaccaacaaccgcggcaagaacauccucuucauguggggcaucaaccacccccccaccgacaccgcccagaccaaccucuacacccgcaccgacaccaccaccuccgucgccaccgaggacaucaaccgcaccuucaagccccucaucggcccccgcccccucgucaacggccuccagggccgcaucgacuacuacugggccguccucaagcccggccagacccuccgcguccgcuccaacggcaaccucaucgcccccugguacggccacauccuccucggcgagucccacggccgcauccucaagaccgaccucaaguccggcaacugcgucguccagugccagaccgagcgcggcggccucaacaccacccuccccuuccacaacgucuccaaguacgccuucggcaacugccccaaguacaucggcgucaagucccucaagcucgccgucggccuccgcaacguccccgcccgcuccucccgcggccucuucggcgccaucgccggcuucaucgagggcggcugguccggccucgucgccggcugguacggcuuccagcacuccaacgaccagggcaccggcauggccgccgaccgcgacuccacccagaaggccaucgacaagaucaccuccaaggucaacaacaucgucgacaagaugaacaagcaguacgagaucaucgaccacgaguucuccgagaucgagacccgccucaacaugaucaacgacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgaccucuaccacaagugcgacaaccagugcauggagaccauccgcaacggcaccuacaaccgccgcaaguaccaggaggagucccgccucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 101793 - RNA, 1683 nt, Artificial Sequence
  derived and/or modified sequence opt2 from hemagglutinin__InfluenzaA__AGQ81128
auggaggccgccaccaucaucaccauccuccucgucaucaccggcuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccaaccucggccgcccccucauccucgacaccugcaccaucgagggccucaucuacggcaaccccuccugcgaccucccccucgagggccgcgagugguccuacaucgucgagcgccccuccgccgucaacggcgucugcuaccccggcaacgucgagaaccucgaggagcuccgcucccucuucuccuccgccuccuccuaccagcgcauccagaucuuccccgacuccaucuggaacgucuccuacuccggcaccuccaaggccugcuccgacuccuucuaccgcuccaugcgcuggcucacccagaagaacaacaacuaccccguccaggacgcccaguacaccaacaaccgcggcaagaacauccucuucauguggggcaucaaccacccccccaccgacaccgcccagaccaaccucuacacccgcaccgacaccaccaccuccgucgccaccgaggacaucaaccgcaccuucaagccccucaucggcccccgcccccucgucaacggccuccagggccgcaucgacuacuacugggccguccucaagcccggccagacccuccgcguccgcuccaacggcaaccucaucgcccccugguacggccacauccuccucggcgagucccacggccgcauccucaagaccgaccucaaguccggcaacugcgucguccagugccagaccgagcgcggcggccucaacaccacccuccccuuccacaacgucuccaaguacgccuucggcaacugccccaaguacaucggcgucaagucccucaagcucgccgucggccuccgcaacguccccgcccgcuccucccgcggccucuucggcgccaucgccggcuucaucgagggcggcugguccggccucgucgccggcugguacggcuuccagcacuccaacgaccagggcaccggcauggccgccgaccgcgacuccacccagaaggccaucgacaagaucaccuccaaggucaacaacaucgucgacaagaugaacaagcaguacgacaucaucgaccacgaguucuccgagaucgagacccgccucaacaugaucaacgacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgaccucuaccacaagugcgacaaccagugcauggagaccauccgcaacggcaccuacaaccgccgcaaguaccaggaggagucccgccucgagcgccagaagaucgagggcgucaagcucgaguccgagggcaccuacaagauccucaccaucuacuccaccgucgccuccucccucgucgucgccaugggcuucgccgccuuccucuucugggccauguccaacggcuccugccgcugcaacaucugcaucuga

SEQ ID NO: 101794 - RNA, 1683 nt, Artificial Sequence
  derived and/or modified sequence opt2 from hemagglutinin__InfluenzaA__AGQ81130
auggagaccgucucccucaucaccauccuccucgucgucaccaucggcaacgccgacaagaucugcaucggcuaccaguccaccaacuccaccgagaccgucgacacccucaccgagaacaacguccccgucacccacgccaaggagcuccuccacaccgagcacaacggcaugcucugcgccaccucccucggccacccccucauccucgacaccugcaccaucgagggccucaucuacggcaaccccuccugcgaccuccuccucggcggccgcgagugguccuacaucgucgagcgccccuccgccgucaacggccucugcuaccccggcaacgucgagaaccucgaggagcuccgcucccucuucuccuccgcccgcuccuaccagcgcauccagaucuuccccgacaccaucuggaacgucuccuacuccggcaccuccaaggccugcuccgacuccuucuaccgcuccaugcgcuggcucacccagaagaacaacgccuaccccauccaggacgcccaguacaccaacaaccaggagaagaacauccucuucauguggggcaucaaccacccccccaccgacaccguccagaccaaccucuacacccgcaccgacaccaccaccuccgucgccaccgaggagaucaaccgcaccuucaagccccucaucggcccccgcccccucgucaacggccuccagggccgcaucgacuacuacugguccguccucaagcccggccagacccuccgcauccgcuccaacggcaaccucaucgcccccugguacggccacauccucuccggcgagucccacggccgcauccucaagaccgaccucaagcgcggcuccugcaccguccagugccagaccgagaagggcggccucaacaccacccuccccuuccagaacgucuccaaguacgccuucggcaacugcuccaaguacaucggcaugaagucccucaagcucgccgucggccuccgcaacguccccucccgcuccucccgcggccucuucggcgccaucgccggcuucaucgagggcggcugguccggccucgucgccggcugguacggcuuccagcacuccaacgaccagggcgucggcauggccgccgaccgcgacuccacccagaaggccaucgacaagaucaccuccaaggucaacaacaucgucgacaagaugaacaagcaguacgagaucaucgaccacgaguucuccgaggucgagacccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuucaacgccgucgaggacggcaagggcugcuucgagcucuaccacaagugcgacgaccagugcauggagaccauccgcaacggcaccuacaaccgccgcaaguaccaggaggaguccaagcucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 101795 - RNA, 1683 nt, Artificial Sequence
  derived and/or modified sequence opt2 from hemagglutinin__InfluenzaA__AGQ81132
auggagaccaucucccucaugaccauccuccucaucaccaccgccuccaacgccgacaagaucugcaucggccaccaguccaccaacuccaccgagaccgucgacacccucaccgagaccaacguccccgucacccacgccaaggagcuccuccagaccgagcacaacggcaugcucugcgccaccaaccucggccacccccucauccucgacaccugcaccaucgagggccucaucuacggcaaccccuccugcgaccuccuccucgagggccgcgagugguccuacaucgucgagcgccccuccgccgucaacggcaccugcuaccccggcaacgucgagaaccucgaggagcuccgcacccucuucuccuccgccuccuccuaccagcgcauccagaucuuccccgacaccaucuggaacgucaccuacaccggcaccucccgcuccugcuccggcuccuucuaccgcuccaugcgcuggcucacccagaaguccggcuucuaccccguccaggacgccaaguacaccaacaaccgcggcaagaacauccucuucgucuggggcauccaccacccccacaccuacaccgaccagaccacccucuacauccgcaacgacaccaccaccuccgucaccaccgaggagcucaaccgcaucuucaagcccgucaucgucccccgccuccucgucaacggccagcagggccgcaucgacuacuacugguccguccucaagcccggccagacccuccgcguccgcuccaacggcaaccucaucgcccccugguacggccacguccucuccggcggcucccacggccgcauccucaagaccgaccucaagggcggcaacugcgucguccagugccagaccgagaagggcggcuucaacuccacccuccccuuccacaacaucuccaaguacgccuucggcaccugccccaaguacgucaaggucaacucccucaagcucgccaucggccuccgcaacguccccgcccgcuccaaccgcggccucuucggcgccaucgccggcuucaucgagggcggcuggcccggccucgucgccggcugguacggcuuccagcacuccaacgaccagggcgucggcauggccgccgaccgcgacuccacccagaaggccgucgacaagaucaccuccaaggucaacaacaucgucgacaagaugaaccgccaguacgagaucaucgaccacgaguucuccgaggucgagacccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccauggaggacggcaagggcugcuucgagcucuaccacaagugcgacgaccagugcauggagaccauccgcaacggcaccuacaaccgccgcaaguaccgcgaggagucccgccucgagcagcagcgcaucgagggcgucaagcucgaguccgagggcaccuacaagauccucaccaucuacuccaccgucgccuccucccucguccucgccaugggcuucgccgccuuccucuucugggccauguccaacggcuccugccgcugcaacaucugcaucuga

SEQ ID NO: 101796 - RNA, 1683 nt, Artificial Sequence
  derived and/or modified sequence opt2 from hemagglutinin__InfluenzaA__AGQ81133
auggagaccaucucccucaugaccauccuccucaucaccaccgccuccaacgccgacaagaucugcaucggccaccaguccaccaacuccaccgagaccgucgacacccucaccgagaccaacguccccgucacccacgccaaggagcuccuccagaccgagcacaacggcaugcucugcgccaccaaccucggccacccccucauccucgacaccugcaccaucgagggccucaucuacggcaaccccuccugcgaccuccuccucgagggccgcgagugguccuacaucgucgagcgccccuccgccgucaacggcaccugcuaccccggcaacgucgagaaccucgaggagcuccgcacccucuucuccuccgccuccuccuaccagcgcauccagaucuuccccgacaccaucuggaacgucaccuacaccggcaccucccgcuccugcuccggcuccuucuaccgcuccaugcgcuggcucacccagaaguccggcuucuaccccguccaggacgccaaguacaccaacaaccgcggcaagaacauccucuucgucuggggcauccaccacccccacaccuacaccgaccagaccacccucuacauccgcaacgacaccaccaccuccgucaccaccgaggagcucaaccgcaucuucaagcccgucaucgucccccgccuccucgucaacggccagcagggccgcaucgacuacuacugguccguccucaagcccggccagacccuccgcguccgcuccaacggcaaccucaucgcccccugguacggccacauccucuccggcggcucccacggccgcauccucaagaccgaccucaaguccggcaacugcgucguccagugccagaccgagaagggcggcuucaacuccacccuccccuuccacaacaucuccaaguacgccuucggcaccugccccaaguacgucaaggucaacucccucaagcucgccaucggccuccgcaacguccccgcccgcuccaaccgcggccucuucggcgccaucgccggcuucaucgagggcggcuggcccggccucgucgccggcugguacggcuuccagcacuccaacgaccagggcgucggcauggccgccgaccgcgacuccacccagaaggccgucgacaagaucaccuccaaggucaacaacaucgucgacaagaugaacaagcaguacgagaucaucgaccacgaguucuccgaggucgagacccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccauggaggacggcaagggcugcuucgagcucuaccacaagugcgacgaccagugcauggagaccauccgcaacggcaccuacaaccgccgcaaguaccgcgaggagucccgccucgagcagcagcgcaucgagggcgucaagcucgaguccgagggcaccuacaagauccucaccaucuacuccaccgucgccuccucccucguccucgccaugggcuucgccgccuuccucuucugggccauguccaacggcuccugccgcugcaacaucugcaucuga

SEQ ID NO: 101797 - RNA, 1683 nt, Artificial Sequence
  derived and/or modified sequence opt2 from hemagglutinin__InfluenzaA__AGQ81134
auggagaccaucucccucaugaccauccuccucaucaccaccgccuccaacgccgacaagaucugcaucggccaccaguccaccaacuccaccgagaccgucgacacccucaccgagaccaacguccccgucacccacgccaaggagcuccuccagaccgagcacaacggcaugcucugcgccaccaaccucggccacccccucauccucgacaccugcaccaucgagggccucaucuacggcaaccccuccugcgaccuccuccucgagggccgcgagugguccuacaucgucgagcgccccuccgccgccaacggcaccugcuaccccggcaacgucgagaaccccgaggagcuccgcacccucuucuccuccgccuccuccuaccagcgcauccagaucuuccccgacaccaucuggaacgucaccuacaccggcaccucccgcuccugcuccggcuccuucuaccgcuccaugcgcuggcucacccagaaguccggcuucuaccccguccaggacgccaaguacaccaacaaccgcggcaagaacauccucuucgucuggggcauccaccacccccacaccuacaccgaccagaccacccucuacauccgcaacgacaccaccaccuccgucaccaccgaggagcucaaccgcaucuucaagcccgucaucgucccccgccuccucgucaacggccagcagggccgcaucgacuacuacugguccguccucaagcccggccagacccuccgcguccgcuccaacggcaaccucaucgcccccugguacggccacguccucuccggcggcucccacggccgcauccucaagaccgaccucaaguccggcaacugcgucguccagugccagaccgagaagggcggcuucaacuccacccuccccuuccacaacaucuccaaguacgccuucggcaccugccccaaguacgucaaggucaacucccucaagcucgccaucggccuccgcaacguccccgcccgcuccaaccgcggccucuucggcgccaucgccggcuucaucgagggcggcuggcccggccucgucgccggcugguacggcuuccagcacuccaacgaccagggcgucggcauggccgccgaccgcgacuccacccagaaggccgucgacaagaucaccuccaaggucaacaacaucgucgacaagaugaacaagcaguacgagaucaucgaccacgaguucuccgaggucgagacccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccauggaggacggcaagggcugcuucgagcucuaccacaagugcgacgaccagugcauggagaccauccgcaacggcaccuacaaccgccgcaaguaccgcgaggagucccgccucgagcagcagcgcaucgagggcgucaagcucgaguccgagggcaccuacaagauccucaccaucuacuccaccgucgccuccucccucguccucgccaugggcuucgccgccuuccucuucugggccauguccaacggcuccugccgcugcaacaucugcaucuga

SEQ ID NO: 101798 - RNA, 1683 nt, Artificial Sequence
  derived and/or modified sequence opt2 from hemagglutinin__InfluenzaA__AGQ81135
auggaggucgccaccaucaucaccauccuccucgucaucaccggcuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccaaccucggccgcccccucauccucgacaccugcaccaucgagggccucaucuacggcaaccccuccugcgaccucccccucgagggccgcgagugguccuacaucgucgagcgccccuccgccgucaacggcgucugcuaccccggcaacgucgagaaccucgaggagcuccgcucccucuucuccuccgccuccuccuaccagcgcauccagaucuuccccgacuccaucuggaacgucuccuacuccggcaccuccaaggccugcuccgacuccuucuaccgcuccaugcgcuggcucacccagaagaacaacaacuaccccguccaggacgcccaguacaccaacaaccgcggcaagaacauccucuucauguggggcaucaaccacccccccaccgacaacgcccagaccaaccucuacacccgcaccgacaccaccaccuccgucgccaccgaggacaucaaccgcaccuucaagccccucaucggcccccgcccccucgucaacggccuccagggccgcaucgacuacuacugggccguccucaagcccggccagacccuccgcguccgcuccaacggcaaccucaucgcccccugguacggccacauccuccucggcgagucccacggccgcauccucaagaccgaccucaaguccggcaacugcgucguccagugccagaccgagcgcggcggccucaacaccacccuccccuuccacaacgucuccaaguacuccuucggcaacugccccaaguacaucggcgucaagucccucaagcucgccgucggccuccgcaacguccccgcccgcuccucccgcggccucuucggcgccaucgccggcuucaucgagggcggcugguccggccucgucgccggcugguacggcuuccagcacuccaacgaccagggcaccggcauggccgccgaccgcgacuccacccagaaggccaucgacaagaucaccuccaaggucaacaacaucgucgacaagaugaacaagcaguacgagaucaucgaccacgaguucaacgagaucgagacccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgaccucuaccacaagugcgacaaccagugcauggagaccauccgcaacggcaccuacaaccgccgcaaguaccaggaggagucccgccucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 101799 - RNA, 1683 nt, Artificial Sequence
  derived and/or modified sequence opt2 from hemagglutinin__InfluenzaA__AGQ81136
auggagaccaucucccucaugaccauccuccucaucaccaccgccuccaacgccgacaagaucugcaucggccaccaguccaccaacuccaccgagaccgucgacacccucaccgagaccaacguccccgucacccacgccaaggagcuccuccagaccgagcacaacggcaugcucugcgccaccaaccucggccacccccucauccucgacaccugcaccaucgagggccucaucuacggcaaccccuccugcgaccuccuccucgagggccgcgagugguccuacaucgucgagcgccccuccgccgucaacggcaccugcuaccccggcaacgucgagaaccucgaggagcuccgcacccucuucuccuccgccuccuccuaccagcgcauccagaucuuccccgacaccaucuggaacgucaccuacaccggcaccucccgcuccugcuccggcuccuucuaccgcuccaugcgcuggcucacccagaaguccggcuucuaccccguccaggacgccaaguacaccaacaaccgcggcaagaacauccucuucgucuggggcauccaccacccccacaccuacaccgaccagaccacccucuacauccgcaacgacaccaccaccuccgucaccaccgaggagcucaaccgcaucuucaagcccgucaucgucccccgccuccucgucaacggccagcagggccgcaucgacuacuacugguccguccucaagcccggccagacccuccgcguccgcuccaacggcaaccucaucgcccccugguacggccacguccucuccggcggcucccacggccgcauccucaagaccgaccucaagggcggcaacugcgucguccagugccagaccgagaagggcggcuucaacuccacccuccccuuccacaacaucuccaaguacgccuucggcaccugccccaaguacgucaaggucaacucccucaagcucgccaucggccuccgcaacguccccgcccgcuccaaccgcggccucuucggcgccaucgccggcuucaucgagggcggcuggcccggccucgucgccggcugguacggcuuccagcacuccaacgaccagggcgucggcauggccgccgaccgcgacuccacccagaaggccgucgacaagaucaccuccaaggucaacaacaucgucgacaagaugaaccgccaguacgagaucaucgaccacgaguucuccgaggucgagacccgccucaacaugaucaacaacaagaucgacgaccagauccaggacaucuggaccuacaacgccgagcuccucguccuccucgagaaccagaagacccucgacgagcacgacgccaacgucaacaaccucuacaacaaggucaagcgcgcccucggcuccaacgccauggaggacggcaagggcugcuucgagcucuaccacaagugcgacgaccagugcauggagaccauccgcaacggcaccuacaaccgccgcaaguaccgcgaggagucccgccucgagcagcagcgcaucgagggcgucaagcucgaguccgagggcaccuacaagauccucaccaucuacuccaccgucgccuccucccucguccucgccaugggcuucgccgccuuccucuucugggccauguccaacggcuccugccgcugcaacaucugcaucuga

SEQ ID NO: 101800 - RNA, 1683 nt, Artificial Sequence; identical to SEQ ID NO: 101795
  derived and/or modified sequence opt2 from hemagglutinin__InfluenzaA__AGQ81137

SEQ ID NO: 101801 - RNA, 1683 nt, Artificial Sequence
  derived and/or modified sequence opt2 from hemagglutinin__InfluenzaA__AGQ81138
auggaggccgccaccaucaucaccauccuccucgccaucaccggcuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccaaccucggccgcccccucauccucgacaccugcaccaucgagggccucaucuacggcaaccccuccugcgaccucccccucgagggccgcgagugguccuacaucgucgagcgccccuccgccgucaacggcgucugcuaccccggccacgucgagaaccucgaggagcuccgcucccucuucuccuccgccuccuccuaccagcgcguccagaucuuccccgacuccaucuggaacgucuccuacuccggcaccuccaaggccugcuccgacuccuucuaccgcuccaugcgcuggcucacccagaagaacaacaacuaccccguccaggacgcccaguacaccaacaacaagggcaagaacauccucuucauguggggcaucaaccacccccccaccgacaccgcccagaccaaccucuacacccgcaccgacaccaccaccuccgucgccaccgaggacaucaaccgcaccuucaagccccucaucggcccccgcccccucgucaacggccuccagggccgcaucgacuacuacugggccguccucaagcccggccagacccuccgcguccgcuccaacggcaaccucaucgcccccugguacggccacauccuccucggcgagucccacggccgcauccucaagaccgaccucaaguccggcaacugcgucguccagugccagaccgagcgcggcggccucaacaccacccuccccuuccacaacgucuccaaguacgccuucggcaacugccccaaguacaucggcgucaagucccucaagcucgccgucggccuccgcaacguccacgcccgcuccucccgcggccucuucggcgccaucgccggcuucaucgagggcggcugguccggccucgucgccggcugguacggcuuccagcacuccaacgaccagggcaccggcauggccgccgaccgcgacuccacccagaaggccaucgacaagaucaccuccaaggucaacaacaucgucgacaagaugaacaagcaguacgagaucaucgaccacgaguucuccgagaucgagacccgccucaacaugaucaacgacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgaccucuaccacaagugcgacaaccagugcauggagaccauccgcaacggcaccuacaaccgccgcaaguaccaggaggagucccgccucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 101802 - RNA, 1683 nt, Artificial Sequence
  derived and/or modified sequence opt2 from hemagglutinin__InfluenzaA__AGQ81139
auggaggucgccaccaucaucaccauccuccucgucaucaccggcggcaacgccgacaagaucugcaucggcuaccaguccaccaacuccaccgagaccgucgacacccucaccgagaacaacguccccgucacccacgccaaggagcuccuccacaccgagcacaacggcaugcucugcgccaccaaccucggccgcccccucauccucgacaccugcaccaucgagggccucaucuacggcaaccccuccugcgaccucccccucgagggccgcgagugguccuacaucgucgagcgcuccuccgccgucaacggcgucugcuaccccggcaacgucgagaaccucgaggagcuccgcucccucuucuccuccgccuccuccuaccagcgcauccagaucuuccccgacuccaucuggaacgucuccuacuccggcaccuccaaggccugcuccgacuccuucuaccgcuccaugcgcuggcucacccagaagaacaacaacuaccccguccaggacgcccaguacaccaacaaccgcggcaagaacauccucuucauguggggcaucaaccacccccccaccgacaacgcccagaccaaccucuacacccgcaccgacaccaccaccuccgucgccaccgaggacaucaaccgcaccuucaagccccucaucggcccccgcccccucgucaacggccuccagggccgcaucgacuacuacugggccguccucaagcccggccagacccuccgcguccgcuccaacggcaaccucaucgcccccugguacggccacauccuccucggcgagucccacggccgcauccucaagaccgaccucaaguccggcaacugcgucguccagugccagaccgagcgcggcggccucaacaccacccuccccuuccacaacgucuccaaguacuccuucggcaacugccccaaguacaucggcgucaagucccucaagcucgccgucggccuccgcaacguccccgcccgcuccucccgcggccucuucggcgccaucgccggcuucaucgagggcggcugguccggccucgucgccggcugguacggcuuccagcacuccaacgaccagggcaccggcauggccgccgaccgcgacuccacccagaaggccaucgacaagaucaccuccaaggucaacaacaucgucgacaagaugaacaagcaguacgagaucaucgaccacgaguucuccgagaucgagacccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgaccucuaccacaagugcgacaaccagugcauggagaccauccgcaacggcaccuacaaccgccgcaaguaccaggaggagucccgccucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 101803 - RNA, 1683 nt, Artificial Sequence
  derived and/or modified sequence opt2 from hemagglutinin__InfluenzaA__AGQ81141
auggaggccgccaccaucaucaccauccuccucgucaucaccggcuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccgaccucggccgcccccucauccucgacaccugcaccaucgagggccucaucuacggcaaccccuccugcgaccucccccucgagggccgcgagugguccuacaucgucgagcgccccuccgccgucaacggcgucugcuaccccggcaacgucgagaaccucgaggagcuccgcucccucuucuccuccgccuccuccuaccagcgcauccagaucuuccccgacuccaucuggaacgucuccuacuccggcaccuccaaggccugcuccgacuccuucuaccgcuccaugcgcuggcucacccagaagaacaacaacuaccccguccaggacgcccaguacaccaacaaccgcggcaagaacauccucuucauguggggcaucaaccacccccccaccgacaccgcccagaccaaccucuacacccgcaccgacaccaccaccuccgucgccaccgaggacaucaaccgcaccuucaagccccucaucggcccccgcccccucgucaacggccuccagggccgcaucgacuacuacugggccguccucaagcccggccagacccuccgcguccgcuccaacggcaaccucaucgcccccugguacggccacauccuccucggcgagucccacggccgcauccucaagaccgaccucaaguccggcaacugcgucguccagugccagaccgagcgcggcggccucaacaccacccuccccuuccacaacgucuccaaguacgccuucggcaacugccccaaguacaucggcgucaagucccucaagcucgccgucggccuccgcaacguccccgcccgcucccgccgcggccucuucggcgccaucgccggcuucaucgagggcggcuggaccggccucgucgccggcugguacggcuuccagcacuccaacgaccagggcaccggcauggccgccgaccgcgacuccacccagaaggccaucgacaagaucaccuccaaggucaacaacaucgucgacaagaugaacaagcaguacgacaucaucgaccacgaguucuccgagaucgagacccgccucaacaugaucaacgacaagaucgacgaccagauccaggacaucugggccuacaacgccgagcuccucguccuccucgagaaccagaagacccucgacgagcacgacgccaacgucaacaaccucuacaacaaggucaagggcgcccucggcuccaacgccgucgaggacggcaagggcugcuucgaccucuaccacaagugcgacaaccagugcauggagaccauccgcaacggcaccuacaaccgccgcaaguaccaggaggagucccgccucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 101804 - RNA, 1683 nt, Artificial Sequence
  derived and/or modified sequence opt2 from hemagglutinin__InfluenzaA__AGQ81143
auggaggucgccaccaucaucaccauccuccucgucaucaccggcuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccaaccucggccgcccccucauccucgacaccugcaccaucgagggccucaucuacggcaaccccuccugcgaccucccccucgagggccgcgagugguccuacaucgucgagcgccccuccgccgucaacggcgucugcuaccccggcaacgucgagaaccucgaggagcuccgcucccucuucuccuccgccuccuccuaccagcgcauccagaucuuccccgacuccaucuggaacgucuccuacuccggcaccuccaaggccugcuccgacuccuucuaccgcuccaugcgcuggcucacccagaagaacaacaacuaccccguccaggacgcccaguacaccaacaaccgcggcaagaacauccucuucauguggggcaucaaccacccccccaccgacaacgcccagaccaaccucuacacccgcaccgacaccaccaccuccgucgccaccgaggacaucaaccgcaccuucaagccccucaucggcccccgcccccucgucaacggccuccagggccgcaucgacuacuacugggccguccucaagcccggccagacccuccgcguccgcuccaacggcaaccucaucgcccccugguacggccacauccuccucggcgagucccacggccgcauccucaagaccgaccucaaguccggcaacugcgucguccagugccagaccgagcgcggcggccucaacaccacccuccccuuccacaacgucuccaaguacuccuucggcaacugccccaaguacaucggcgucaagucccucaagcucgccgucggccuccgcaacguccccgcccgcuccucccgcggccucuucggcgccaucgccggcuucaucgagggcggcugguccggccucgucgccggcugguacggcuuccagcacuccaacgaccagggcaccggcauggccgccgaccgcgacuccacccagaaggccaucgacaagaucaccuccaaggucaacaacaucgucgacaagaugaacaagcaguacgagaucaucgaccacgaguucuccgagaucgagacccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgaccucuaccacaagugcgacaaccagugcauggagaccauccgcaacggcaccuacaaccgccgcaaguaccaggaggagucccgccucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 101805 - RNA, 1683 nt, Artificial Sequence
  derived and/or modified sequence opt2 from hemagglutinin__InfluenzaA__AGQ81144
auggaggccgccaccaucaucaccauccuccucgucgucaccggcuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccaaccucggccgcccccucauccucgacaccugcaccaucgagggccucaucuacggcaaccccuccugcgaccucccccucgagggccgcgagugguccuacaucgucgagcgccccuccgccgucaacggcgucugcuaccccggcaacgucgagaaccucgaggagcuccgcucccucuucuccuccgccuccuccuaccagcgcauccagaucuuccccgacuccaucuggaacgucuccuacggcggcaccuccaaggccugcuccgacuccuucuaccgcuccaugcgcuggcucacccagaagaacaacaacuaccccguccaggacgcccaguacaccaacaaccgcggcaagaacauccucuucauguggggcaucaaccacccccccaccgacaccgcccagaccaaccucuacacccgcaccgacaccaccaccuccgucgccaccgaggacaucaaccgcaccuucaagccccucaucggcccccgcccccucgucaacggccuccagggccgcaucgacuacuacugggccguccucaagcccggccagacccuccgcguccgcuccaacggcaaccucaucgcccccugguacggccacauccuccucggcgagucccacggccgcauccucaagaccgaccucaaguccggcaacugcgucguccagugccagaccgagcgcggcggccucaacaccacccuccccuuccacaacgucuccaaguacgccuucggcaacugccccaaguacaucggcgucaagucccucaagcucgccgucggccuccgcaacaugcccgcccgcuccucccgcggccucuucggcgccaucgccggcuucaucgagggcggcugguccggccucgucgccggcugguacggcuuccagcacuccaacgaccagggcaccggcauggccgccgaccgcgacuccacccagaaggccaucgacaagaucaccuccaaggucaacaacaucgucgacaagaugaacaagcaguacgagaucaucgaccacgaguucuccgagaucgagacccgccucaacaugaucaacgacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgaccucuaccacaagugcgacaaccagugcauggagaccauccgcaacggcaccuacaaccgccgcaaguaccaggaggagucccgccucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 101806 - RNA, 1683 nt, Artificial Sequence
  derived and/or modified sequence opt2 from hemagglutinin__InfluenzaA__AGQ81146
auggaggccgccaccaucaucaccauccuccucgucaucaccggcuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccaaccucggccgcccccucauccucgacaccugcaccaucgagggccucaucuacggcaaccccuccugcgaccucccccucgagggcaaggagugguccuacaucgucgagcgccccuccgccgucaacggcaugugcuaccccggcaacgucgagaaccucgaggagcuccgcucccucuucuccuccgccuccuccuaccagcgcauccagaucuuccccgacuccaucuggaacgucuccuacuccggcaccuccaaggccugcuccgacuccuucuaccgcuccaugcgcuggcucacccagaagaacaacaacuaccccguccaggacgcccaguacaccaacaaccgcggcaagaacauccucuucauguggggcaucaaccacccccccaccgacaccgcccagaccaaccucuacacccgcaccgacaccaagaccuccgucgccaccgaggagaucaaccgcaccuucaagccccucaucggcccccgcccccucgucaacggccuccagggccgcaucgacuacuacugggccguccucaagcccggccagacccuccgcguccgcuccaacggcaaccucaucgcccccugguacggccacauccuccucggcgagucccacggccgcauccucaagaccgaccucaaguccggcaacugcgucguccagugccagaccgagcgcggcggccucaacaccacccuccccuuccacaacgucuccaaguacgccuucggcaacugccccaaguacaucggcgucaagucccucaagcucgccgucggccuccgcaacguccccgcccgcuccucccgcggccucuucggcgccaucgccggcuucaucgagggcggcugguccggccucgucgccggcugguacggcuuccagcacuccaacgaccagggcaccggcauggccgccgaccgcgacuccacccagaaggccaucgacaagaucaccuccaaggucaacaacaucgucgacaagaugaacaagcaguacgagaucaucgaccacgaguucuccgagaucgagacccgccucaacaugaucaacgacaagaucgacgaccagauccaggacaucugggccuacaacgccgagcuccucguccuccucgagaaccagaagacccucgacgagcacgacuccaacgucaacaaccucuacaacaaggucaagcgcgcccucggcuccaacgccgucgaggacggcaagggcugcuucgaccucuaccacaagugcgacaaccagugcauggagaccauccgcaacggcaccuacaaccgccgcaaguaccaggaggagucccgccucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 101807 - RNA, 1683 nt, Artificial Sequence
  derived and/or modified sequence opt2 from hemagglutinin__InfluenzaA__AGQ81147
auggaggccgccaccaucaucaccauccuccucgucaucaccggcuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccaaccucggccgcccccucauccucgacaccugcaccaucgagggccucaucuacggcaaccccuccugcgaccucccccucgagggcaaggagugguccuacaucgucgagcgccccuccgccgucaacggcaugugcuaccccggcaacgucgagaaccucgaggagcuccgcucccucuucuccuccgccuccuccuaccagcgcauccagaucuuccccgacuccaucuggaacgucuccuacuccggcaccuccaaggccugcuccgacuccuucuaccgcuccaugcgcuggcucacccagaagaacaacaacuaccccguccaggacgcccaguacaccaacaaccgcggcaagaacauccucuucauguggggcaucaaccacccccccaccgacaccguccagaccaaccucuacacccgcaccgacaccaagaccuccgucgccaccgaggagaucaaccgcaccuucaagccccucaucggcccccgcccccucgucaacggccuccagggccgcaucgacuacuacugggccguccucaagcccggccagacccuccgcguccgcuccaacggcaaccucaucgcccccugguacggccacauccuccucggcgagucccacggccgcauccucaagaccgaccucaaguccggcaacugcgucguccagugccagaccgagcgcggcggccucaacaccacccuccccuuccacaacgucuccaaguacgccuucggcaacugccccaaguacaucggcgucaagucccucaagcucgccgucggccuccgcaacguccccgcccgcuccucccgcggccucuucggcgccaucgccggcuucaucgagggcggcugguccggccucgucgccggcugguacggcuuccagcacuccaacgaccagggcaccggcauggccgccgaccgcgacuccacccagaaggccaucgacaagaucaccuccaaggucaacaacaucgucgacaagaugaacaagcaguacgagaucaucgaccacgaguucuccgagaucgagacccgccucaacaugaucaacgacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgaccucuaccacaagugcgacaaccagugcauggagaccauccgcaacggcaccuacaaccgccgcaaguaccaggaggagucccgccucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 101808 - RNA, 1683 nt, Artificial Sequence
  derived and/or modified sequence opt2 from hemagglutinin__InfluenzaA__AGQ81148
auggaggccgccaccaucaucaccauccuccucgucaucaccggcuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccaaccucggccgcccccucauccucgacaccugcaccaucgagggccucaucuacggcaaccccuccugcgaccucccccucgagggcaaggagugguccuacaucgucgagcgccccuccgccgucaacggcaugugcuaccccggcaacgucgagaaccucgaggagcuccgcucccucuucuccuccgccuccuccuaccagcgcauccagaucuuccccgacuccaucuggaacgucuccuacuccggcaccuccaaggccugcuccgacuccuucuaccgcuccaugcgcuggcucacccagaagaacaacaacuaccccguccaggacgcccaguacaccaacaaccgcggcaagaacauccucuucauguggggcaucaaccacccccccaccgacaccgcccagaccaaccucuacacccgcaccgacaccaagaccuccgucgccaccgaggagaucaaccgcaccuucaagccccucaucggcccccgcccccucgucaacggccuccagggccgcaucgacuacuacugggccguccucaagcccggccagacccuccgcguccgcuccaacggcaaccucaucgcccccugguacggccacauccuccucggcgagucccacggccgcauccucaagaccgaccucaaguccggcaacugcgucguccagugccagaccgagcgcggcggccucaacaccacccuccccuuccacaacgucuccaaguacgccuucggcaacugccccaaguacaucggcgucaagucccucaagcucgccgucggccuccgcaacguccccgcccgcuccucccgcggccucuucggcgccaucgccggcuucaucgagggcggcugguccggccucgucgccggcugguacggcuuccagcacuccaacgaccagggcaccggcauggccgccgaccgcgacuccacccagaaggccaucgacaagaucaccuccaaggucaacaacaucgucgacaagaugaacaagcaguacgagaucaucgaccacgaguucuccgagaucgagacccgccucaacaugaucaacgacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgaccucuaccacaagugcgacaaccagugcauggagaccauccgcaacggcaccuacaaccgccgcaaguaccaggaggagucccgccucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 101809 - RNA, 1683 nt, Artificial Sequence
  derived and/or modified sequence opt2 from hemagglutinin__InfluenzaA__AGQ81149
auggaggccgccaccaucaucaccauccuccucgucaucaccggcuccaacgccgacaagaucugcaucggcuaccaguccaccaacuccaccgagaccgucgacacccucaccgagaacaacguccccgucacccacgccaaggagcuccuccacaccggccacaacggcaugcucugcgccaccaaccucggccgcccccucauccucgacaccugcaccaucgagggccucaucuacggcaaccccuccugcgaccucccccucgagggccgcgagugguccuacaucgucgagcgccccuccgccaucaacggcgucugcuaccccggcaacgucgagaaccucgaggagcuccgcucccucuucuccuccgccuccuccuaccagcgcauccagaucuuccccgacuccaucuggaacgucuccuacuccggcaccuccaaggccugcuccgacuccuucuaccgcuccaugcgcuggcucacccagaagaacaacaacuaccccguccaggacgcccaguacaccaacaaccgcggcaagaacauccucuucauguggggcaucaaccacccccccaccgacaccgcccagaccaaccucuacacccgcaccgacaccaccaccuccgucgccaccgaggacaucaaccgcaccuucaagccccucaucggcccccgcccccucgucaacggccuccagggccgcaucgacuacuacugggccguccucaagcccggccagacccuccgcguccgcuccaacggcaaccucaucgcccccugguacggccacauccuccucggcgagucccacggccgcauccucaagaccgaccucaaguccggcaacugcgucguccagugccagaccgagcgcggcggccucaacaccacccuccccuuccacaacgucuccaaguacgccuucggcaacugccccaaguacaucggcgucaagucccucaagcucgccgucggccuccgcaacguccccgcccgcuccucccgcggccucuucggcgccaucgccggcuucaucgagggcggcugguccggccucgucgccggcugguacggcuuccagcacuccaacgaccagggcaccggcauggccgccgaccgcgacuccacccagaaggccaucgacaagaucaccuccaaggucaacaacaucgucgacaagaugaacaagcaguacgagaucaucgaccacgaguucuccgagaucgagacccgccucaacaugaucaacgacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgaccucuaccacaagugcgacaaccagugcauggagaccauccgcaacggcaccuacaaccgccgcaaguaccaggaggagucccgccucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 101810 - RNA, 1683 nt, Artificial Sequence
  derived and/or modified sequence opt2 from hemagglutinin__InfluenzaA__AGQ81150
auggaggccgccaccaucaucaccauccuccucgucaucaccggcuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccgaccucggccgcccccucauccucgacaccugcaccaucgagggccucaucuacggcaaccccuccugcgaccucccccucgagggccgcgagugguccuacaucgucgagcgccccuccgccgucaacggcgucugcuaccccggcaacgucgagaaccucgaggagcuccgcucccucuucuccuccgccuccuccuaccagcgcauccagaucuuccccgacuccaucuggaacgucuccuacuccggcaccuccaaggccugcuccgacuccuucuaccgcuccaugcgcuggcucacccagaagaacaacaacuaccccguccaggacgcccaguacaccaacgaccgcggcaacaacauccucuucauguggggcaucaaccacccccccaccgacaccguccagaccaaccucuacacccgcaccgacaccaccaccuccgucgccaccgaggacaucaaccgcaccuucaagccccucaucggcccccgcccccucgucaacggccuccagggccgcaucgacuacuacugggccguccucaagcccggccagacccuccgcguccgcuccaacggcaaccucaucgcccccugguacggccacauccuccucggcgagucccacggccgcauccucaagaccgaccucaaguccggcaacugcgucguccagugccagaccgagcgcggcggccucaacaccacccuccccuuccacaacgucuccaaguacgccuucggcaacugccccaaguacaucggcgucaagucccucaagcucgccgucggccuccgcaacguccccgcccgcuccucccgcggccucuucggcgccaucgccggcuucaucgagggcggcugguccggccucgucgccggcugguacggcuuccagcacuccaacgaccagggcaccggcauggccgccgaccgcgacuccacccagaaggccaucgacaagaucaccuccaaggucaacaacaucgucgacaagaugaacaagcaguacgacaucaucgaccacgaguucuccgagaucgagacccgccucaacaugaucaacgacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgaccucuaccacaagugcgacaaccagugcauggagaccauccgcaacggcaccuacaaccgccgcaaguaccaggaggagucccgccucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 101811 - RNA, 1683 nt, Artificial Sequence
  derived and/or modified sequence opt2 from hemagglutinin__InfluenzaA__AGQ81152
auggaggccgccaccaucaucaccauccuccucgucaucaccggcuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccaaccucggccgcccccucauccucgacaccugcaccaucgagggccucaucuacggcaaccccuccugcgaccucccccucgagggccgcgacugguccuacaucgucgagcgccccuccgccgucaacggcgucugcuaccccggcaacgucgagaaccucgaggagcuccgcucccucuucuccuccgccuccuccuaccagaagauccagaucuuccccgacuccaucuggaacgucuccuacuccggcaccuccaaggccugcuccgacuccuucuaccgcuccaugcgcuggcucacccagaagaacaacaacuaccccguccaggacgcccaguacaccaacaaccgcggcaagaacauccucuucauguggggcaucaaccacccccccaccgacaccguccagaccaaccucuacacccgcaccgacaccaccaccuccgucgccaccgaggacaucaaccgcaccuucaagccccucaucggcccccgcccccucgucaacggccuccagggccgcaucgacuacuacugggccguccucaagcccggccagacccuccgcguccgcuccaacggcaaccucaucgcccccugguacggccacauccuccucggcgagucccacggccgcauccucaagaccgaccucaaguccggcaacugcgucguccagugccagaccgagcgcggcggccucaacaccacccuccccuuccacaacgucuccaaguacgccuucggcaacugccccaaguacaucggcgucaagucccucaagcucgccgucggccuccgcaacguccccgcccgcuccucccgcggccucuucggcgccaucgccggcuucaucgagggcggcugguccggccucgucgccggcugguacggcuuccagcacuccaacgaccagggcaccggcauggccgccgaccgcgacuccacccagaaggccaucgacaagaucaccuccaaggucaacaacaucgucgacaagaugaacaagcaguacgagaucaucgaccacgaguucuccgagaucgagacccgccucaacaugaucaacgacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgaccucuaccacaagugcgacaaccagugcauggagaccauccgcaacggcaccuacaaccgccgcaaguaccaggaggagucccgccucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 101812 - RNA, 1683 nt, Artificial Sequence
  derived and/or modified sequence opt2 from hemagglutinin__InfluenzaA__AGQ81153
auggaggccgccaccaucaucaccauccuccucgucaucaccggcuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccaaccucggccgcccccucauccucgacaccugcaccaucgagggccucaucuacggcaaccccuccugcgaccucccccucgagggccgcgacugguccuacaucgucgagcgccccuccgccgucaacggcgucugcuaccccggcaacgucgagaaccucgaggagcuccgcucccucuucuccuccgccuccuccuaccagaagauccagaucuuccccgacuccaucuggaacgucuccuacggcggcaucuccaaggccugcuccaacuccuucuaccgcuccaugcgcuggcucacccagaagaacaacaacuaccccguccaggacgcccaguacaccaacaaccgcggcaagaacauccucuucauguggggcaucaaccacccccccaccaacaccacccagaccgaccucuacacccgcaccgacaccaccaccuccgucgccaccgaggacauccaccgcaccuucaagccccucaucggcccccgcccccucgucaacggccuccagggccgcaucgacuacuacugggccguccucaagcccggccagacccuccgcguccgcuccaacggcaaccucaucgcccccugguacggccacauccuccucggcaagucccacggccgcauccucaagaccgaccucaaguccggcaacugcgucguccagugccagaccgagcgcggcggccucaacaccacccuccccuuccacaacgucuccaaguacgccuucggcaacugccccaaguacaucggcgucaagucccucaagcucgccgucggccuccgcaacguccccgcccgcuccucccgcggccucuucggcgccaucgccggcuucaucgagggcggcugguccggccucgucgccggcugguacggcuuccagcacuccaacgaccagggcaccggcauggccgccgaccgcgacuccacccagaaggccaucgacaagaucaccuccaaggucaacaacaucgucgacaagaugaacaagcaguacgagaucaucgaccacgaguucuccgagaucgagacccgccucaacaugaucaacgacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgaccucuaccacaagugcgacaaccagugcauggagaccauccgcaacggcaccuacaaccgccgcaaguaccaggaggagucccgccucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 101813 - RNA, 1683 nt, Artificial Sequence
  derived and/or modified sequence opt2 from hemagglutinin__InfluenzaA__AGQ81155
auggaggccgccaccaucaucaccauccuccucgucaucaccggcuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccaaccucggccgcccccucauccucgacaccugcaccaucgagggccucaucuacggcaaccccuccugcgaccucccccucgagggccgcgacugguccuacaucgucgagcgccccuccgccgucaacggcgucugcuaccccggcaacgucgagaaccucgaggagcuccgcucccucuucuccuccgccuccuccuaccagaagauccagaucuuccccgacuccaucuggaacgucuccuacaacggcaccuccaaggccugcuccgacuccuucuaccgcuccaugcgcuggcucacccagaagaacaacaacuaccccguccaggacgcccaguacaccaacaaccgcggcaagaacauccucuucauguggggcaucaaccacccccccaccgacaccacccagaccaaccucuacacccgcaccgacaccaccaccuccgucgccaccgaggacaucaaccgcaccuucaagccccucaucggcccccgcccccucgucaacggccuccagggccgcaucgacuacuacugggccguccucaagcccggccagacccuccgcguccgcuccaacggcaaccucaucgcccccugguacggccacauccuccucggcgagucccacggccgcauccucaagaccgaccucaaguccggcaacugcgucguccagugccagaccgagcgcggcggccucaacaccacccuccccuuccacaacgucuccaaguacgccuucggcgacugccccaaguacaucggcgucaagucccucaagcucgccgucggccuccgcaacguccccgcccgcuccucccgcggccucuucggcgccaucgccggcuucaucgagggcggcugguccggccucgucgccggcugguacggcuuccagcacuccaacgaccagggcaccggcauggccgccgaccgcgacuccacccagaaggccaucgacaagaucaccuccaaggucaacaacaucgucgacaagaugaacaagcaguacgagaucaucgaccacgaguucuccgagaucgagacccgccucaacaugaucaacgacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgaccucuaccacaagugcgacaaccagugcauggagaccauccgcaacggcaccuacaaccgccgcaaguaccaggaggagucccgccucgagcgccaggagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 101814 - RNA, 1683 nt, Artificial Sequence
  derived and/or modified sequence opt2 from hemagglutinin__InfluenzaA__AGQ81156
auggaggccgccaccaucaucaccauccuccucgucaucaccggcuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccaaccucggccgcccccucauccucgacaccugcaccaucgagggccucaucuacggcaaccccuccugcgaccucccccucgagggccgcgacugguccuacaucgucgagcgccccuccgccgucaacggcgucugcuaccccggcaacgucgagaaccucgaggagcuccgcucccucuucuccuccgccuccuccuaccagaagauccagaucuuccccgacuccaucuggaacgucuccuacggcggcaucuccaaggccugcuccaacuccuucuaccgcuccaugcgcuggcucacccagaagaacaacaacuaccccguccaggacgcccaguacaccaacaaccgcggcaagaacauccucuucauguggggcaucaaccacccccccaccaacaccacccagaccgaccucuacacccgcaccgacaccaccaccuccgucgccaccgaggacauccaccgcaccuucaagccccucaucggcccccgcccccucgucaacggccuccagggccgcaucgacuacuacugggccguccucaagcccggccagacccuccgcguccgcuccaacggcaaccucaucgcccccugguacggccacauccuccucggcgagucccacggccgcauccucaagaccgaccucaaguccggcaacugcgucguccagugccagaccgagcgcggcggccucaacaccacccuccccuuccacaacgucuccaaguacgccuucggcaacugccccaaguacaucggcgucaagucccucaagcucgccgucggccuccgcaacguccccgcccgcuccucccgcggccucuucggcgccaucgccggcuucaucgagggcggcugguccggccucgucgccggcugguacggcuuccagcacuccaacgaccagggcaccggcauggccgccgaccgcgacuccacccagaaggccaucgacaagaucaccuccaaggucaacaacaucgucgacaagaugaacaagcaguacgagaucaucgaccacgaguucuccgagaucgagacccgccucaacaugaucaacgacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgaccucuaccacaagugcgacaaccagugcauggagaccauccgcaacggcaccuacaaccgccgcaaguaccaggaggagucccgccucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 101815 - RNA, 1683 nt, Artificial Sequence
  derived and/or modified sequence opt2 from hemagglutinin__InfluenzaA__AGQ81157
auggaggccgccaccaucaucaccauccuccucgucaucaccggcaacaacgccgacaagaucugcaucggcuaccaguccaccaacuccaccgagaccgucgacacccucaccgagaacaacguccccgucacccacgccaaggagcuccuccacaccgagcacaacggcaugcucugcgccaccaaccucggccgcccccucauccucgacaccugcaccaucgagggccucaucuacggcaaccccuccugcgaccucccccucgagggccgcgacugguccuacaucgucgagcgccccuccgccgucaacggcgucugcuaccccggcaacgucgagaaccucgaggagcuccgcucccucuucuccuccgccuccuccuaccagaagauccagaucuuccccgacuccaucuggaacgucuccuacaacggcaccuccaaggccugcuccgacuccuucuaccgcuccaugcgcuggcucacccagaagaacaacaacuaccccguccaggacgcccaguacaccaacaaccgcggcaagaacauccucuucauguggggcaucaaccacccccccaccgacaccacccagaccaaccucuacacccgcaccgacaccaccaccuccgucgccaccgaggacaucaaccgcaccuucaagccccucaucggcccccgcccccucgucaacggccuccagggccgcaucgacuacuacugggccguccucaagcccggccagacccuccgcguccgcuccaacggcaaccucaucgcccccugguacggccacauccuccucggcgagucccacggccgcauccucaagaccgaccucaaguccggcaacugcgucguccagugccagaccgagcgcggcggccucaacaccacccuccccuuccacaacgucuccaaguacgccuucggcgacugccccaaguacaucggcgucaagucccucaagcucgccgucggccuccgcaacguccccgcccgcuccucccgcggccucuucggcgccaucgccggcuucaucgagggcggcugguccggccucgucgccggcugguacggcuuccagcacuccaacgaccagggcaccggcauggccgccgaccgcgacuccacccagaaggccaucgacaagaucaccuccaaggucaacaacaucgucgacaagaugaacaagcaguacgagaucaucgaccacgaguucuccgagaucgagacccgccucaacaugaucaacgacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgaccucuaccacaagugcgacaaccagugcauggagaccauccgcaacggcaccuacaaccgccgcaaguaccaggaggagucccgccucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 101816 - RNA, 1683 nt, Artificial Sequence
  derived and/or modified sequence opt2 from hemagglutinin__InfluenzaA__AGQ81158
auggaggucgucaccaucaucaccauccuccucgucaucacccgcuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccaaccucggccgcccccucauccucgacaccugcaccaucgagggccucaucuacggcaaccccuccugcgaccucccccucgagggccgcgagugguccuacaucgucgagcgccccuccgccgucaacggcgucugcuaccccggcaacgucgagaaccucgaggagcuccgcucccucuucuccuccgccuccuccuaccagcgcauccagaucuuccccgacuccaucuggaacgucuccuacuccggcaccuccaaggccugcuccgacuccuucuaccgcuccaugcgcuggcucacccagaagaacaacaacuaccccguccaggacgcccaguacaccaacaaccgcggcaagaacauccucuucauguggggcaucaaccacccccccaccgacaccgcccagaccaaccucuacacccgcaccgacaccaccaccuccgucgccaccgaggacaucaaccgcaccuucaagccccucaucggcccccgcccccucgucaacggccuccagggccgcaucgacuacuacugggccguccucaagcccggccagacccuccgcguccgcuccaacggcaaccucaucgcccccugguacggccacauccuccucggcgagucccacggccgcauccucaagaccgaccucaaguccggcuccugcgucguccagugccagaccgagcgcggcggccucaacaccacccuccccuuccacaacgucuccaaguacgccuucggcaacugccccaaguacaucggcgucaagucccucaagcucgccgucggccuccgcaacguccccgcccgcuccucccgcggccucuucggcgccaucgccggcuucaucgagggcggcugguccggccucgucgccggcugguacggcuuccagcacuccaacgaccagggcaccggcauggccgccgaccgcgacuccacccagaaggccaucgacaagaucaccuccaaggucaacaacaucgucgacaagaugaacaagcaguacgagaucaucaaccacgaguucuccgagaucgagacccgccucaacaugaucaacgacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgaccucuaccacaagugcgacaaccagugcauggagaccauccgcaacggcaccuacaaccgccgcauguaccaggaggagucccgccucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 101817 - RNA, 1683 nt, Artificial Sequence
  derived and/or modified sequence opt2 from hemagglutinin__InfluenzaA__AGQ81159
auggaggccgccaccaucaucaccauccuccucgucaucaccggcuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccaaccucggccgcccccucauccucgacaccugcaccaucgagggccucaucuacggcaaccccuccugcgaccucccccucgagggccgcgacugguccuacaucgucgagcgccccuccgccgucaacggcgucugcuaccccggcaacgucgagaaccucgaggagcuccgcucccucuucuccuccgccuccuccuaccagaagauccagaucuuccccgacuccaucuggaacgucuccuacgacggcaucuccaaggccugcuccaacuccuucuaccgcuccaugcgcuggcucaccaagaagaacaacuccuaccccguccaggacgcccaguacaccaacaacaucggcaagaacauccucuucauguggggcaucaaccacccccccaccaacaccacccagaccgaccucuacacccgcaccgacaccaccaccuccgucgccaccgaggacauccaccgcaccuucaagccccucaucggcccccgcccccccgucaacggccuccucggccgcaucgacuacuacugggccguccucaagcccggccagacccuccgcguccgcuccaacggcaaccucaucgcccccugguacggccacauccuccucggcgagucccacggccgcauccucaagaccgaccucaaguccggcaacugcgucguccagugccagaccgagcgcggcggccucaacaccacccuccccuuccacaacgucuccaaguacgccuucggcaacugccccaaguacaucggcgucaagucccucaagcucgccgucggccuccgcaacguccccgcccgcuccucccgcggccucuucggcgccaucgccggcuucaucgagggcggcugguccggccucgucgccggcugguacggcuuccagcacuccaacgaccagggcaccggcauggccgccgaccgcgacuccacccagaaggccaucgacaagaucaccuccaaggucaacaacaucgucgacaagaugaacaagcaguacgagaucaucgaccacgaguucuccgagaucgagacccgccucaacaugaucaacgacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgaccucuaccacaagugcgacaaccagugcauggagaccauccgcaacggcaccuacaaccgccgcaaguaccaggaggagucccgccucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 101818 - RNA, 1683 nt, Artificial Sequence
  derived and/or modified sequence opt2 from hemagglutinin__InfluenzaA__AGQ81161
auggagaccgucucccucaucaccauccuccucgucgccaccgucuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccucccucggccagccccucauccucgacaccugcaccaucgagggccucaucuacggcaaccccuccugcgacccccuccucgagggccgcgagugguccuacaucgucgagcgccccuccgccgucaacggccucugcuaccccggcaacgucgagaaccucgaggagcuccgcucccucuucuccuccgcccgcuccuaccagcgcauccagaucuuccccgacaccaucuggaacgucuccuacgacggcaccuccaaggccugcuccggcuccuucuaccgcaacaugcgcuggcucacccagaagaacuccgacuaccccauccaggacgcccaguacaccaacaaccagggcaagaacauccucuucauguggggcaucaaccacccccccaccgacaccacccagcgcgaccucuacacccgcaccgacaccaccaccuccgucgccaccgaggagaucaaccgcaucuucaagccccucaucggcccccgcccccucgucaacggccucaugggccgcaucgacuacuacugguccguccucaagcccggccagacccuccgcaucaaguccgacggcaaccucaucgcccccugguacggccacauccucuccggcgagucccacggccgcauccucaagaccgaccucaagaagggcuccugcaccguccagugccagaccgagaagggcggccucaacaccacccuccccuuccagaacgucuccaaguacgccuucggcaacugcuccaaguacaucggcaucaagucccucaagcucgccgucggccuccgcaacguccccucccgcuccucccgcggccucuucggcgccaucgccggcuucaucgagggcggcugguccggccucgucgccggcugguacggcuuccagcacuccaacgaccagggcgucggcauggccgccgaccgcgacuccacccagaaggccaucgacaagaucaccuccaaggucaacaacaucgucgacaagaugaacaagcaguacgagaucaucgaccacgaguucuccgaggucgagacccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgagcucuaccacaagugcgacgaccagugcauggagaccauccgcaacggcaccuacaaccgccgcaaguaccaggaggaguccaagcucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 101819 - RNA, 1683 nt, Artificial Sequence
  derived and/or modified sequence opt2 from hemagglutinin__InfluenzaA__AGQ81162
auggagaccgucucccucaucaccauccuccucgucgccaccgucuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccucccucggccagccccucauccucgacaccugcaccaucgagggccucaucuacggcaaccccuccugcgaccuccuccucgagggccgcgagugguccuacaucgucgagcgccccuccgccgucaacggccucugcuaccccggcaacgucgagaaccucgaggagcuccgcucccucuucuccuccgcccgcuccuaccagcgcauccagaucuuccccgacaccaucuggaacgucuccuacgacggcaccuccaaggccugcuccggcuccuucuaccgcuccaugcgcuggcucacccagaagaacuccgacuaccccauccaggacgcccaguacaccaacaaccagggcaagaacauccucuucauguggggcaucaaccacccccccaccgacaccacccagcgcgaccucuacacccgcaccgacaccaccaccuccgucgccaccgaggagaucaaccgcaucuucaagccccucaucggcccccgcccccucgucaacggccucaugggccgcaucgacuacuacugguccguccucaagcccggccagacccuccgcaucaaguccgacggcaaccucaucgcccccugguacggccacauccucuccggcgagucccacggccgcauccucaagaccgaccucaagaagggcuccugcaccguccagugccagaccgagaagggcggccucaacaccacccuccccuuccagaacgucuccaaguacgccuucggcaacugcuccaaguacaucggcaucaagucccucaagcucgccgucggccuccgcaacguccccucccgcuccucccgcggccucuucggcgccaucgccggcuucaucgagggcggcugguccggccucgucgccggcugguacggcuuccagcacuccaacgaccagggcgucggcauggccgccgaccgcgacuccacccagaaggccaucgacaagaucaccuccaaggucaacaacaucgucgacaagaugaacaagcaguacgagaucaucgaccacgaguucuccgaggucgagacccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgagcucuaccacaagugcgacgaccagugcauggagaccauccgcaacggcaccuacaaccgcaagaaguaccaggaggaguccaagcucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 101820 - RNA, 1683 nt, Artificial Sequence
  derived and/or modified sequence opt2 from hemagglutinin__InfluenzaA__AGQ81164
auggagaccgucucccucaucaccauccuccucgucgccaccgucuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccucccucggccagccccucauccucgacaccugcaccaucgagggccucaucuacggcaaccccuccugcgaccuccuccucgagggccgcgagugguccuacaucgucgagcgccccuccgccgucaacggccucugcuaccccggcaacgucgagaaccucgaggagcuccgcucccucuucuccuccgcccgcuccuaccagcgcauccagaucuuccccgacaccaucuggaacgucuccuacgacggcaccuccaaggccugcuccggcuccuucuaccgcuccaugcgcuggcucacccagaagaacuccgacuaccccauccaggacgcccaguacaccaacaaccagggcaagaacauccucuucauguggggcaucaaccacccccccaccgacaccacccagcgcgaccucuacacccgcaccgacaccaccaccuccgucgccaccgaggagaucaaccgcaucuucaagccccucaucggcccccgcccccucgucaacggccucaugggccgcaucgacuacuacugguccguccucaagcccggccagacccuccgcaucaaguccgacggcaaccucaucgcccccugguacggccacauccucuccggcgagucccacggccgcauccucaagaccgaccucaagaagggcuccugcaccguccagugccagaccgagaagggcggccucaacaccacccuccccuuccagaacgucuccaaguacgccuucggcaacugcuccaaguacaucggcaucaagucccucaagcucgccgucggccuccgcaacguccccucccgcuccucccgcggccucuucggcgccaucgccggcuucaucgagggcggcugguccggccucgucgccggcugguacggcuuccagcacuccaacgaccagggcgucggcauggccgccgaccgcgacuccacccagaaggccaucgacaagaucaccuccaaggucaacaacaucgucgacaagaugaacaagcaguacgagaucaucgaccacgaguucuccgaggucgagacccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgagcucuaccacaagugcgacgaccagugcauggagaccauccgcaacggcaccuacaaccgccgcaaguaccaggaggaguccaagcucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 101821 - RNA, 1683 nt, Artificial Sequence
  derived and/or modified sequence opt2 from hemagglutinin__InfluenzaA__AGQ81167
auggagaccgucucccucaucaccauccuccucgucgccaccgucuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccucccucggccagccccucauccucgacaccugcaccaucgagggccucaucuacggcaaccccuccugcgaccuccuccucgagggccgcgagugguccuacaucgucgagcgccccuccgccgucaacggccucugcuaccccggcaacgucgagaaccucgaggagcuccgcucccucuucuccuccgcccgcuccuaccagcgcauccagaucuuccccgacaccaucuggaacgucuccuacaacggcaccuccaaggccugcuccggcuccuucuaccgcuccaugcgcuggcucacccagaagaacuccaacuaccccauccaggacgcccaguacaccaacaaccagggcaagaacauccucuucauguggggcaucaaccacccccccaccgacaccacccagcgcgaccucuacacccgcaccgacaccaccaccuccgucgccaccgaggagaucaaccgcaucuucaagccccucaucggcccccgcccccucgucaacggccucaugggccgcaucgacuacuacugguccguccucaagcccggccagacccuccgcaucaaguccgacggcaaccucaucgcccccugguacggccacauccucuccggcgagucccacggccgcauccucaagaccgaccucaagaagggcuccugcaccguccagugccagaccgagaagggcggccucaacaccacccuccccuuccagaacgucuccaaguacgccuucggcaacugcuccaaguacaucggcaucaagucccucaagcucgccgucggccuccgcaacguccccucccgcuccucccgcggccucuucggcgccaucgccggcuucaucgagggcggcugguccggccucgucgccggcugguacggcuuccagcacuccaacgaccagggcgucggcauggccgccgaccgcgacuccacccagaaggccaucgacaagaucaccuccaaggucaacaacaucgucgacaagaugaacaagcaguacgagaucaucgaccacgaguucuccgaggucgagacccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgagcucuaccacaagugcgacgaccagugcauggagaccauccgcaacggcaccuacaaccgccgcaaguaccaggaggaguccaagcucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 101822 - RNA, 1683 nt, Artificial Sequence
  derived and/or modified sequence opt2 from hemagglutinin__InfluenzaA__AGQ81168
auggagaccgucucccucaucaccauccuccucgucgucaccgucuccaacgccgacaagaucugcaucggcuaccaguccaccaacuccaccgagaccgucgacacccucaccgagaacaacguccccgucacccacgcccgcgagcuccuccacaccgagcacaacggcaugcucugcgccaccucccucggccacccccucauccucgacaccugcaccaucgagggccucaucuacggcaaccccuccugcgaccuccuccucggcggccgcgagugguccuacaucgucgagcgccccuccgccgucaacggccucugcuaccccggcaacgucgagaaccucgaggagcuccgcucccucuucuccuccgcccgcuccuaccagcgcauccagaucuuccccgacaccaucuggaacgucuccuacuccggcaccuccaaggccugcuccgacuccuucuaccgcuccaugcgcuggcucacccagaagggcaacgccuaccccauccaggacgcccaguacaccaacaaccagggcaagaacauccucuucauguggggcaucaaccacccccccaccgacaccgcccagaccaaccucuacacccgcaccgacaccaccaccuccgucgccaccgaggagaucaaccgcaccuucaagccccucaucggcccccgcccccucgucaacggccucaugggccgcaucaacuacuacugguccguccucaagcccggccagacccuccgcaucaaguccaacggcaaccucaucgcccccugguacggccacauccucuccggcgagucccacggccgcauccucaagaccgaccucaagcgcggcuccugcaccguccagugccagaccgagaagggcggccucaacaccacccuccccuuccagaacgucuccaaguacgccuucggcaacugcuccaaguacaucggcaugaagucccucaagcucgccgucggccuccgcaacguccccucccgcuccucccgcggccucuucggcgccaucgccggcuucaucgagggcggcugguccggccucgucgccggcugguacggcuuccagcacuccaacgaccagggcgucggcauggccgccgaccgcgacuccacccagaaggccaucgacaagaucaccuccaaggucaacaacaucgucgacaagaugaacaagcaguacgagaucaucgaccacgaguucuccgaggucgagacccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgagcucuaccacaagugcgacgaccagugcauggagaccauccgcaacggcaccuacaaccgccgcaaguaccaggaggaguccaagcucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 101823 - RNA, 1683 nt, Artificial Sequence
  derived and/or modified sequence opt2 from hemagglutinin__InfluenzaA__AGQ81169
auggagaccgucucccucaucaccauccuccucgucgucaccgucuccaacgccgacaagaucugcaucggcuaccaguccaccaacuccaccgagaccgucgacacccucaccgagaacaacguccccgucacccacgcccgcgagcuccuccacaccgagcacaacggcaugcucugcgccaccucccucggccacccccucauccucgacaccugcaccaucgagggccucaucuacggcaaccccuccugcgaccuccuccucggcggccgcgagugguccuacaucgucgagcgccccuccgccgucaacggccucugcuaccccggcaacgucgagaaccucgaggagcuccgcucccucuucuccuccgcccgcuccuaccagcgcauccagaucuuccccgacaccaucuggaacgucuccuacuccggcaccuccaaggccugcuccgacuccuucuaccgcuccaugcgcuggcucacccagaaggacaacgccuaccccauccaggacgcccaguacaccaacaaccaggagaagaacauccucuucauguggggcaucaaccacccccccaccgacaccguccagaccaaccucuacacccgcaccgacaccaccaccuccgucgccaccgaggagaucaaccgcaccuucaagccccucaucggcccccgcccccucgucaacggccucaugggccgcaucaacuacuacugguccguccucaagcccggccagacccuccgcaucaaguccaacggcaaccucaucgcccccugguacggccacauccucuccggcgagucccacggccgcauccucaagaccgaccucaagcgcggcuccugcaccguccagugccagaccgagaagggcggccucaacaccacccuccccuuccagaacgucuccaaguacgccuucggcaacugcuccaaguacaucggcaugaagucccucaagcucgccgucggccuccgcaacguccccucccgcuccucccgcggccucuucggcgccaucgccggcuucaucgagggcggcugguccggccucgucgccggcugguacggcuuccagcacuccaacgaccagggcgucggcauggccgccgaccgcgacuccacccagaaggccaucgacaagaucaccuccaaggucaacaacaucgucgacaagaugaacaagcaguacgagaucaucgaccacgaguucuccgaggucgagacccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgagcucuaccacaagugcgacgaccagugcauggagaccauccgcaacggcaccuacaaccgccgcaaguaccaggaggaguccaagcucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 101824 - RNA, 1683 nt, Artificial Sequence
  derived and/or modified sequence opt2 from hemagglutinin__InfluenzaA__AGQ81170
auggagaccgucucccucaucaccauccuccucgucgucaccgucuccaacgccgacaagaucugcaucggcuaccaguccaccaacuccaccgagaccgucgacacccucaccgagaacaacguccccgucacccacgcccgcgagcuccuccacaccgagcacaacggcaugcucugcgccaccucccucggccacccccucauccucgacaccugcaccaucgagggccucaucuacggcaaccccuccugcgaccuccuccucggcggccgcgagugguccuacaucgucgagcgccccuccgccgucaacggccucugcuaccccggcaacgucgagaaccucgaggagcuccgcucccucuucuccuccgcccgcuccuaccagcgcauccagaucuuccccgacaccaucuggaacgucuccuacuccggcaccuccaaggccugcuccgacuccuucuaccgcuccaugcgcuggcucacccagaaggacaacgccuaccccauccaggacgcccaguacaccaacaaccagggcaagaacauccucuucauguggggcaucaaccacccccccaccgacaccgcccagaccaaccucuacacccgcaccgacaccaccaccuccgucgccaccgaggagaucaaccgcaccuucaagccccucaucggcccccgcccccucgucaacggccucaugggccgcaucaacuacuacugguccguccucaagcccggccagacccuccgcaucaaguccaacggcaaccucaucgcccccugguacggccacauccucuccggcgagucccacggccgcauccucaagaccgaccucaagcgcggcuccugcaccguccagugccagaccgagaagggcggccucaacaccacccuccccuuccagaacgucuccaaguacgccuucggcaacugcuccaaguacaucggcaugaagucccucaagcucgccgucggccuccgcaacguccccucccgcuccucccgcggccucuucggcgccaucgccggcuucaucgagggcggcugguccggccucgucgccggcugguacggcuuccagcacuccaacgaccagggcgucggcauggccgccgaccgcgacuccacccagaaggccaucgacaagaucaccuccaaggucaacaacaucgucgacaagaugaacaagcaguacgagaucaucgaccacgaguucuccgaggucgagacccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgagcucuaccacaagugcgacgaccagugcauggagaccauccgcaacggcaccuacaaccgccgcaaguaccaggaggaguccaagcucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 101825 - RNA, 1683 nt, Artificial Sequence; identical to SEQ ID NO: 101824
  derived and/or modified sequence opt2 from hemagglutinin__InfluenzaA__AGQ81171

SEQ ID NO: 101826 - RNA, 1683 nt, Artificial Sequence; identical to SEQ ID NO: 101824
  derived and/or modified sequence opt2 from hemagglutinin__InfluenzaA__AGQ81172

SEQ ID NO: 101827 - RNA, 1683 nt, Artificial Sequence
  derived and/or modified sequence opt2 from hemagglutinin__InfluenzaA__AGQ81173
auggagaccgccucccucaucaccauccuccucgucgucaccgucuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccucccucggcaacccccucauccucgacaccugcaccaucgagggccucaucuacggcaaccccuccugcgaccuccuccucggcggccgcgagugguccuacaucgucgagcgccccuccgccgucaacggccucugcuaccccggcaacgucgagaaccucgaggagcuccgcucccucuucuccuccgcccgcuccuaccagcgcauccagaucuuccccgacaccaucuggaacgucuccuacuccggcaccuccaaggccugcuccgacuccuucuaccgcuccaugcgcuggcucacccagaaggacaacgccuaccccauccaggacgcccaguacaccaacaaccagggcaagaacauccucuucauguggggcaucaaccacccccccaccgacaccgcccagaccaaccucuacacccgcaccgacaccaccaccuccgucgccaccgaggagaucaaccgcaccuucaagccccucaucggcccccgcccccucgucaacggccucaugggccgcaucaacuacuacugguccguccucaagcccggccagacccuccgcaucaaguccaacggcaaccucaucgcccccugguacggccacauccucuccggcgagucccacggccgcauccucaagaccgaccucaagcgcggcuccugcaccguccagugccagaccgagaagggcggccucaacaccacccuccccuuccagaacgucuccaaguacgccuucggcaacugcuccaaguacaucggcaugaagucccucaagcucgccgucggccuccgcaacguccccucccgcuccucccgcggccucuucggcgccaucgccggcuucaucgagggcggcugguccggccucgucgccggcugguacggcuuccagcacuccaacgaccagggcgucggcauggccgccgaccgcgacuccacccagaaggccaucgacaagaucaccuccaaggucaacaacaucgucgacaagaugaacaagcaguacgagaucaucgaccacgaguucuccgaggucgagacccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgagcucuaccacaagugcgacgaccagugcauggagaccauccgcaacggcaccuacaaccgccgcaaguaccaggaggaguccaagcucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 101828 - RNA, 1683 nt, Artificial Sequence; identical to SEQ ID NO: 101824
  derived and/or modified sequence opt2 from hemagglutinin__InfluenzaA__AGQ81175

SEQ ID NO: 101829 - RNA, 1683 nt, Artificial Sequence
  derived and/or modified sequence opt2 from hemagglutinin__InfluenzaA__AGQ81177
auggagaccgucucccucaucaccauccuccucgucgccaccgucuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccucccucggccagccccucauccucgacaccugcaccaucgagggccucaucuacggcaaccccuccugcgaccuccuccucgagggccgcgagugguccuacaucgucgagcgccccuccgccgucaacggccucugcuaccccggcaacgucgagaaccucgaggagcuccgcucccucuucuccuccgcccgcuccuaccagcgcauccagaucuuccccgacaccaucuggaacgucuccuacaacggcaccuccaaggccugcuccggcuccuucuaccgcuccaugcgcuggcucacccgcaagaacggcgacuaccccauccaggacgcccaguacaccaacaaccagggcaagaacauccucuucauguggggcaucaaccacccccccaccgacaccacccagcgcgaccucuacacccgcaccgacaccaccaccuccgucgccaccgaggagaucaaccgcaucuucaagccccucaucggcccccgcccccucgucaacggccucaugggccgcaucgacuacuacugguccguccucaagcccggccagacccuccgcaucaaguccgacggcaaccucaucgcccccugguacggccacauccucuccggcgagucccacggccgcauccucaagaccgaccucaagcgcggcuccugcaccguccagugccagaccgagaagggcggccucaacaccacccuccccuuccagaacgucuccaaguacgccuucggcaacugcuccaaguacaucggcaucaagucccucaagcucgccgucggccuccgcaacguccccucccgcuccucccgcggccucuucggcgccaucgccggcuucaucgagggcggcugguccggccucgucgccggcugguacggcuuccagcacuccaacgaccagggcgucggcauggccgccgaccgcgacuccacccagaaggccaucgacaagaucaccuccaaggucaacaacaucgucgacaagaugaacaagcaguacgagaucaucgaccacgaguucuccgaggucgagacccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgagcucuaccacaagugcgacgaccagugcauggagaccauccgcaacggcaccuacaaccgccgcaaguaccaggaggaguccaagcucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 101830 - RNA, 1683 nt, Artificial Sequence; identical to SEQ ID NO: 101829
  derived and/or modified sequence opt2 from hemagglutinin__InfluenzaA__AGQ81178

SEQ ID NO: 101831 - RNA, 1683 nt, Artificial Sequence; identical to SEQ ID NO: 101821
  derived and/or modified sequence opt2 from hemagglutinin__InfluenzaA__AGQ81181

SEQ ID NO: 101832 - RNA, 1683 nt, Artificial Sequence; identical to SEQ ID NO: 101821
  derived and/or modified sequence opt2 from hemagglutinin__InfluenzaA__AGQ81183

SEQ ID NO: 101833 - RNA, 1683 nt, Artificial Sequence; identical to SEQ ID NO: 101820
  derived and/or modified sequence opt2 from hemagglutinin__InfluenzaA__AGQ81184

SEQ ID NO: 101834 - RNA, 1683 nt, Artificial Sequence
  derived and/or modified sequence opt2 from hemagglutinin__InfluenzaA__AGQ81185
auggagaccgccucccucaucaccauccuccucgucgccaccgucuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccucccucggccagccccucauccucgacaccugcaccaucgagggccucaucuacggcaaccccuccugcgaccuccuccucgagggccgcgagugguccuacaucgucgagcgccccuccgccgucaacggccucugcuaccccggcaacgucgagaaccucgaggagcuccgcucccucuucuccuccgcccgcuccuaccagcgcauccagaucuuccccgacaccaccuggaacgucuccuacaacggcaccuccaaggccugcuccggcuccuucuaccgcuccaugcgcuggcucacccagaagaacuccaacuaccccauccaggacgcccaguacaccaacaaccagggcaagaacauccucuucauguggggcaucaaccacccccccaccgacaccacccagcgcgaccucuacacccgcaccgacaccaccaccuccgucgccaccgaggagaucaaccgcaucuucaagccccucaucggcccccgcccccucgucaacggccucaugggccgcaucgacuacuacugguccguccucaagcccggccagacccuccgcaucaaguccgacggcaaccucaucgcccccugguacggccacauccucuccggcgagucccacggccgcauccucaagaccgaccucaagcgcggcuccugcaccguccagugccagaccgagaagggcggccucaacaccacccuccccuuccagaacgucuccaaguacgccuucggcaacugcuccaaguacaucggcaucaagucccucaagcucgccgucggccuccgcaacguccccucccgcuccucccgcggccucuucggcgccaucgccggcuucaucgagggcggcugguccggccucgucgccggcugguacggcuuccagcacuccaacgaccagggcgucggcauggccgccgaccgcgacuccacccagaaggccaucgacaagaucaccuccaaggucaacaacaucgucgacaagaugaacaagcaguacgagaucaucgaccacgaguucuccgaggucgagacccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgagcucuaccacaagugcgacaaccagugcauggagaccauccgcaacggcaccuacaaccgccgcaaguaccaggaggaguccaagcucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 101835 - RNA, 1683 nt, Artificial Sequence
  derived and/or modified sequence opt2 from hemagglutinin__InfluenzaA__AGQ81186
auggagaccgucucccucaucaccauccuccucgucgccaccgucuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccucccucggccagccccucauccucgacaccugcaccaucgagggccucaucuacggcaaccccuccugcgaccuccuccucgagggccgcgagugguccuacaucgucgagcgccccuccgccgucaacggccucugcuaccccggcaacgucgagaaccucgaggagcuccgcucccucuucuccuccgcccgcuccuaccagcgcauccagaucuuccccgacaccaucuggaacgucuccuacgacggcaccuccaaggccugcuccggcuccuucuaccgcuccaugcgcuggcucacccagaagaacuccgacuaccccauccaggacgcccaguacaccaacaaccagggcaagaacauccucuucauguggggcaucaaccacccccccaccgacaccacccagcgcgaccucuacacccgcaccgacaccaccaccuccgucgccaccgaggagaucaaccgcaucuucaagccccucaucggcccccgcccccucgucaacggccucaugggccgcaucgacuacuacugguccguccucaagcccggccagacccuccgcaucaaguccgacggcaaccucaucgcccccugguacggccacauccucuccggcgagucccacggccgcauccucaagaccgaccucaagaagggcuccugcaccguccagugccagaccgagaagggcggccucaacaccacccuccccuuccagaacgucuccaaguacgccuucggcaacugcuccaaguacaucggcaucaagucccucaagcucgccaucggccuccgcaacguccccucccgcuccucccgcggccucuucggcgccaucgccggcuucaucgagggcggcugguccggccucgucgccggcugguacggcuuccagcacuccaacgaccagggcgucggcauggccgccgaccgcgacuccacccagaaggccaucgacaagaucaccuccaaggucaacaacaucgucgacaagaugaacaagcaguacgagaucaucgaccacgaguucuccgaggucgagacccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgagcucuaccacaagugcgacgaccagugcauggagaccauccgcaacggcaccuacaaccgcaagaaguaccaggaggaguccaagcucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 101836 - RNA, 1683 nt, Artificial Sequence; identical to SEQ ID NO: 101824
  derived and/or modified sequence opt2 from hemagglutinin__InfluenzaA__AGQ81190

SEQ ID NO: 101837 - RNA, 1683 nt, Artificial Sequence; identical to SEQ ID NO: 101824
  derived and/or modified sequence opt2 from hemagglutinin__InfluenzaA__AGQ81191

SEQ ID NO: 101838 - RNA, 1683 nt, Artificial Sequence; identical to SEQ ID NO: 101829
  derived and/or modified sequence opt2 from hemagglutinin__InfluenzaA__AGQ81192

SEQ ID NO: 101839 - RNA, 1683 nt, Artificial Sequence
  derived and/or modified sequence opt2 from hemagglutinin__InfluenzaA__AGQ81193
auggagaccgucucccucaucaccauccuccucgucgccaccgucuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccucccucggccagccccucauccucgacaccugcaccaucgagggccucaucuacggcaaccccuccugcgaccuccuccucgagggccgcgagugguccuacaucgucgagcgccccuccgccgucaacggccucugcuaccccggcaacgucgagaaccucgaggagcuccgcucccucuucuccuccgcccgcuccuaccagcgcauccagaucuuccccgacaccaucuggaacgucuccuacaccggcaccuccaaggccugcuccggcuccuucuaccgcuccaugcgcuggcucacccagaagaacggcgacuaccccauccaggacgcccaguacaccaacaaccagggcaagaacauccucuucauguggggcaucaaccacccccccaccgacaccacccagcgcgaccucuacacccgcaccgacaccaccaccuccgucgccaccgaggagaucaaccgcaucuucaagccccucaucggcccccgcccccucgucaacggccucaugggccgcaucgacuacuacugguccguccucaagcccggccagacccuccgcaucaaguccgacggcaaccucaucgcccccugguacggccacguccucuccggcgagucccacggccgcauccucaagaccgaccucaagcgcggcuccugcaccguccagugccagaccgagaagggcggccucaacaccacccuccccuuccagaacgucuccaaguacgccuucggcaacugcuccaaguacaucggcaucaagucccucaagcucgccgucggccuccgcaacguccccucccgcuccucccgcggccucuucggcgccaucgccggcuucaucgagggcggcugguccggccucgucgccggcugguacggcuuccagcacuccaacgaccagggcgucggcauggccgccgaccgcgacuccacccagaaggccaucgacaagaucaccuccaaggucaacaacaucgucgacaagaugaacaagcaguacgagaucaucgaccacgaguucuccgaggucgagacccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgagcucuaccacaagugcgacgaccagugcauggagaccauccgcaacggcaccuacaaccgccgcaaguaccaggaggaguccaagcucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 101840 - RNA, 1683 nt, Artificial Sequence; identical to SEQ ID NO: 101824
  derived and/or modified sequence opt2 from hemagglutinin__InfluenzaA__AGQ81194

SEQ ID NO: 101841 - RNA, 1686 nt, Artificial Sequence
  derived and/or modified sequence opt2 from hemagglutinin__InfluenzaA__AGQ81195
auguacaagaucgucgucaucaucacccuccucggcaccgucaagggccucgacaagaucugccucggccaccacgccgucgccaacggcaccaucgucaagacccucaccaacgagcaggaggaggucaccaacgccaccgagaccgucgagggcaagucccucaaccgccucugcaugaagggccgcaaccacaaggaccucggcaacugccaccccaucggcaugcucaucggcacccccgccugcgaccuccaccucaccggcaccugggacacccucaucgagcgcgagaacgccaucgccuacugcuaccccggcgccaccaucaacgaggaggcccuccgccagaagaucauggaguccggcggcaucuccaagaucuccaccggcuucaccuacggcuccuccaucaacuccgccggcaccacccgcgccugcaugcgcaacggcggcaacuccuucuacgccgagcucaaguggcucgucuccaaguccaagggccagaacuucccccagaccaccaacaccuaccgcaacaccgacaccuccgagcaccucaucauguggggcauccaccaccccuccuccacccaggagaagaacgaccucuacggcacccagucccucuccaucuccgucggcuccuccaccuaccagaacaacuucguccccgucgucggcgcccgcccccaggucaacggccaguccggccgcaucgacuuccacuggacccucguccagcccggcgacaacaucaccuucucccacaacggcggccucaucgcccccucccgcgucuccaagcucaucggccgcggccucggcauccaguccgacgccuccaucgacaacaacugcgaguccaagugcuucuggcgcggcggcuccaucaacacccgccuccccuuccagaaccucuccccccgcaccgucggccagugccccaaguacgucaacaagcgcucccucaugcucgccaccggcaugcgcaacguccccgagaucaugcagggccgcggccucuucggcgccaucgccggcuucaucgagaacggcugggagggcauggucgacggcugguacggcuuccgccaccagaacgcccagggcaccggccaggccgccgacuacaaguccacccaggccgccaucgaccagaucaccggcaagcucaaccgccucaucgagaagaccaacaccgaguucgaguccaucgaguccgaguucuccgagaucgagcaccagaucggcaacgucaucaacuggaccaaggacuccaucaccgacaucuggaccuaccaggccgagcuccucgucgccauggagaaccagcacaccaucgacauggccgacuccgagaugcucaaccucuacgagcgcguccgcaagcagcuccgccagaacgccgaggaggacggcaagggcugcuucgagaucuaccacgccugcgacgacuccugcauggaguccauccgcaacaacaccuacgaccacucccaguaccgcgaggaggcccuccucaaccgccucaacaucaaccccgucacccucuccuccggcuacaaggacaucauccucugguucuccuucggcgccuccugcuucguccuccucgccgucgucaugggccucgucuucuucugccucaagaacggcaacaugcgcugcaccaucugcaucuga

SEQ ID NO: 101842 - RNA, 1686 nt, Artificial Sequence
  derived and/or modified sequence opt2 from hemagglutinin__InfluenzaA__AGQ81196
auguacaagaucgucgucaucaucgcccuccucggcgccgucaagggccucgacaagaucugccucggccaccacgccgucgccaacggcaccaucgucaagacccucaccaacgagcaggaggaggucaccaacgccaccgagaccgucgaguccgccucccucaaccgccucugcaugaagggccgcucccacaaggaccucggcaacugccaccccaucggcaugcucaucggcacccccgccugcgaccuccaccucaccggcaccugggacacccucaucgagcgcgagaacgccaucgccuacugcuaccccggcgccaccgucaacgaggaggcccuccgccagaagaucauggaguccggcggcaucuccaagaucuccaccggcuucaccuacggcuccuccaucaacuccgccggcaccaccaaggccugcaugcgcaaccgcggcaacuccuucuacgccgagcucaaguggcucgucuccaaguccaagggccagaacuucccccagaccaccaacaccuaccgcaacaccgacaccgccgagcaccucaucauguggggcauccaccaccccuccuccacccaggagaagaacgaccucuacggcacccagucccucuccaucuccgucggcuccuccaccuaccagaacaacuucguccccgucgucggcgcccgcccccaggucaacggccaguccggccgcaucgacuuccacuggacccucguccagcccggcgacaacaucaccuucucccacaacggcggccucaucgcccccucccgcgucuccaagcucgucggccgcggccucggcauccaguccgacgcccccaucgacaacaacugcgaguccaagugcuucuggcgcggcggcuccaucaacacccgccuccccuuccagaaccucuccccccgcaccgucggccagugccccaaguacgucaacaagcgcucccucaugcucgccaccggcaugcgcaacguccccgagaucaugcagggccgcggccucuucggcgccaucgccggcuucaucgagaacggcugggagggcauggucgacggcugguacggcuuccgccaccagaacgcccagggcaccggccaggccgccgacuacaaguccacccagaccgccaucgaccagaucaccggcaagcucaaccgccucaucgagaagaccaacaccgaguucgaguccaucgaguccgaguucuccgagaucgagcaccagaucggcaacgucaucaacuggaccaaggacuccaucaccgacaucuggaccuaccaggccgagcuccucgucgccauggagaaccagcacaccaucgacauggccgacuccgagaugcucaaccucuacgagcgcguccgcaagcagcuccgccagaacgccgaggaggacggcaagggcugcuucgagaucuaccacgccugcgacgacuccugcauggaguccauccgcaacaacaccuacgaccacucccaguaccgcgaggaggcccuccucaaccgccucaacaucaaccccgucaagcucuccuccggcuacaaggacaucauccucugguucuccuucggcgccuccugcuucguccuccucgccgucgucaugggccucgucuucuucugccucaagaacggcaacaugcgcugcaccaucugcaucuga

SEQ ID NO: 101843 - RNA, 1686 nt, Artificial Sequence
  derived and/or modified sequence opt2 from hemagglutinin__InfluenzaA__AGQ81198
auguacaagaucgucgucaucaucgcccuccucggcgccgucaagggccucgacaagaucugccucggccaccacgccgucgccaacggcaccaucgucaagacccucaccaacgagcaggaggaggucaccaacgccaccgagaccgucgaguccaccucccucaaccgccucugcaugaagggccgcaaccacaaggaccucggcaacugccaccccaucggcaugcucaucggcacccccgccugcgaccuccaccucaccggcaccugggacacccucaucgagcgcgagaacgccaucgccuacugcuaccccggcgccaccaucaacgaggaggcccuccgccagaagaucauggaguccggcggcaucuccaagaucuccaccggcuucaccuacggcuccuccaucaacuccgccggcaacaccaaggccugcaugcgcaacggcggcaacuccuucuacgccgagcuccgcuggcucgucuccaagaacaagggccagaacuucccccagaccaccaacaccuaccgcaacaccgacaccgccgagcaccucaucaucuggggcauccaccaccccuccuccaccaaggagaagaacgaccucuacggcacccagucccucuccaucuccgucggcuccuccaccuaccagaacaacuucguccccgucgucggcgcccgcccccaggucaacggccaguccggccgcaucgacuuccacuggacccucguccagcccggcgacaacaucaccuucucccacaacggcggccucaucgcccccucccgcgucuccaagcucaucggccgcggccucggcauccaguccgacgcccccaucgacaacaacugcgaguccaagugcuucuggcgcggcggcuccaucaacacccgccuccccuuccagaaccucuccccccgcaccgucggccagugccccaaguacgucaacaagaagucccucaugcucgccaccggcaugcgcaacguccccgagaucaugcagggccgcggccucuucggcgccaucgccggcuucaucgagaacggcugggagggcauggucgacggcugguacggcuuccgccaccagaacgcccagggcaccggccaggccgccgacuacaaguccacccaggccgccaucgaccagaucaccggcaagcucaaccgccucaucgagaagaccaacaccgaguucgaguccaucgaguccgaguucuccgagaucgagcaccagaucggcaacgucaucaacuggaccaaggacuccaucaccgacaucuggaccuaccaggccgagcuccucgucgccauggagaaccagcacaccaucgacauggccgacuccgagaugcucaaccucuacgagcgcguccgcaagcagcuccgccagaacgccgaggaggacggcaagggcugcuucgagaucuaccacgccugcgacgacuccugcauggaguccauccgcaacaacaccuacgaccacucccaguaccgcgaggaggcccuccucaaccgccucaacaucaaccccgucacccucuccuccggcuacaaggacaucauccucugguucuccuucggcgccuccugcuucguccuccucgccgucgucaugggccucgucuucuucugccucaagaacggcaacaugcgcugcaccaucugcaucuga

SEQ ID NO: 101844 - RNA, 1686 nt, Artificial Sequence
  derived and/or modified sequence opt2 from hemagglutinin__InfluenzaA__AGQ81199
auguacaagaucgucgucaucaucgcccuccucggcgccgucaagggccucgacaagaucugccucggccaccacgccgucgccaacggcaccaucgucaagacccucaccaacgagcaggaggaggucaccaacgccaccgagaccgucgaguccgccucccucaaccgccucugcaugaagggccgcucccacaaggaccucggcaacugccaccccaucggcaugcucaucggcacccccgccugcgaccuccaccucaccggcaccugggacacccucaucgagcgcgagaacgccaucgccuacugcuaccccggcgccaccgucaacgaggaggcccuccgccagaagaucauggaguccggcggcaucuccaagaucuccaccggcuucaccuacggcuccuccaucaacuccgccggcaccaccaaggccugcaugcgcaacggcggcaacuccuucuacgccgagcucaaguggcucgucuccaaguccaagggccagaacuucccccagaccaccaacaccuaccgcaacaccgacaccgccgagcaccucaucauguggggcauccaccaccccuccuccacccaggagaagaacgaccucuacggcacccagucccucuccaucuccgucggcuccuccaccuaccagaacaacuucguccccgucgucggcgcccgcccccaggucaacggccaguccggccgcaucgacuuccacuggacccucguccagcccggcgacaacaucaccuucucccacaacggcggccucaucgcccccucccgcgucuccaagcucgucggccgcggccucggcauccaguccgacgcccccaucgacaacaacugcgaguccaagugcuucuggcgcggcggcuccaucaacacccgccuccccuuccagaaccucuccccccgcaccgucggccagugccccaaguacgucaacaagcgcucccucaugcucgccaccggcaugcgcaacguccccgagaucaugcagggccgcggccucuucggcgccaucgccggcuucaucgagaacggcugggagggcauggucgacggcugguacggcuuccgccaccagaacgcccagggcaccggccaggccgccgacuacaaguccacccagaccgccaucgaccagaucaccggcaagcucaaccgccucaucgagaagaccaacaccgaguucgaguccaucgaguccgaguucuccgagaucgagcaccagaucggcaacgucaucaacuggaccaaggacuccaucaccgacaucuggaccuaccaggccgagcuccucgucgccauggagaaccagcacaccaucgacauggccgacuccgagaugcucaaccucuacgagcgcguccgcaagcagcuccgccagaacgccgaggaggacggcaagggcugcuucgagaucuaccacgccugcgacgacuccugcauggaguccauccgcaacaacaccuacgaccacucccaguaccgcgaggaggcccuccucaaccgccucaacaucaaccccgucaagcucuccuccggcuacaaggacaucauccucugguucuccuucggcgccuccugcuucguccuccucgccgucgucaugggccucgucuucuucugccucaagaacggcaacaugcgcugcaccaucugcaucuga

SEQ ID NO: 101845 - RNA, 1698 nt, Artificial Sequence
  derived and/or modified sequence opt2 from hemagglutinin__InfluenzaA__AGQ81200
augaagaagacccuccucuucgccgccaucuuccucuacgucaaggccgacgagaucugcaucggcuaccucuccaacaacuccaccgacaaggucgacaccaucaucgagaacaacgucaccgucaccuccuccgucgagcucgucgagaccgagcacaccggcuccuucugcuccaucaacggcaagcagcccaucggccucggcgacugcuccuucgccggcuggauccucggcaaccccaugugcgacgaccucaucggcaagaccuccugguccuacaucgucgagaagcccaaccccgccaacggcaucugcuaccccggcacccucgagaacgaggaggagcuccgccucaaguucuccggcguccucgaguucuccaaguucgaggccuucaccuccaccggcuggggcgccgucaacuccggcgccggcgucaccgccgccugcaaguucggcuccuccaacuccuucuuccgcaacauggucuggcucauccaccaguccggcaccuaccccgucaucaagcgcaccuucaacaacaccaagggccgcgacguccucgucgucuggggcauccaccaccccgccacccucaaggagcaccaggaccucuacaagaaggacuccuccuacgucgccgucggcuccgagaccuacaaccgccgcuucauccccgagaucuccacccgccccaaggucaacggccaggccggccgcaugaccuucuacuggaccaucgucaagcccggcgaguccaucaccuucgaguccaacggcgccuuccucgccccccgcuacgccuucgagaucgucuccgucggcaacggcaagcucuuccgcuccgagcucaacaucgaguccugcuccaccaagugccagaccgagaucggcggcaucaacaccaacaaguccuuccacuccguccaccgcaacaccaucggcgacugccccaaguacgucaacgucaagucccucaagcucgccaccggccuccgcaacguccccgccaucgccucccgcggccucuucggcgccaucgccggcuucaucgagggcggcuggcccggccucaucaacggcugguacggcuuccagcaccgcaacgaggagggcaccggcaucgccgccgacaaggaguccacccagaaggccaucgaccagaucaccuccaaggucaacaacaucgucgacaagaugaacaccaacuucgaguccguccagcacgaguucuccgagaucgaggagcgcaucaaccagcucuccaagcacgucgacgacuccgucgucgacaucugguccuacaacgcccagcuccucguccuccucgagaacgagaagacccucgaccuccacgacuccaacguccgcaaccuccacgagaagguccgccgcaugcucaaggacaacgccaaggacgagggcaacggcugcuucaccuucuaccacaagugcgacaacgagugcaucgagcgcguccgcaacggcaccuacgaccacaaggaguucgaggaggaguccaagaucaaccgccaggagaucgagggcgucaagcucgacuccuccggcaacgucuacaagauccucuccaucuacuccugcaucgccuccucccucguccucgccgcccucaucaugggcuucauccucugggccugcuccaacggcuccugccgcugcaccaucugcaucuga

SEQ ID NO: 101846 - RNA, 1698 nt, Artificial Sequence
  derived and/or modified sequence opt2 from hemagglutinin__InfluenzaA__AGQ81202
augaagaagacccuccucuucgccgccaucuuccucuacgucaaggccgacgagaucugcaucggcuaccucuccaacaacuccaccgacaaggucgacaccaucaucgagaacaacgucaccgucaccuccuccgucgagcucgucgagaccgagcacaccggcuccuucugcuccaucaacggcaagcagcccaucucccucggcgacugcuccuucgccggcuggauccucggcaaccccaugugcgacgaccucaucggcaagaccuccugguccuacaucgucgagaagcccaaccccgccaacggcaucugcuaccccggcacccucgagaacgaggaggagcuccgccucaaguucuccggcguccucgaguucuccaaguucgaggccuucaccuccaacggcuggggcgccgucaacuccggcgccggcgucaccgccgccugcaaguucggcuccuccaacuccuucuuccgcaacaccgucuggcucauccaccaguccggcaccuaccccgucaucaagcgcaccuucaacaacaccaagggccgcgacguccucgucgucuggggcguccaccaccccgccacccucaaggagcaccaggaccucuacaagaaggacuccuccuacgucgccgucggcuccgagaccuacaaccgccgcuucauccccgagaucuccacccgccccaaggucaacggccaggccggccgcaugaccuucuacuggaccaucgucaagcccggcgaguccaucaccuucgaguccaacggcgccuuccucgccccccgcuacgccuucgagaucgucuccgucggcaacggcaagcucuuccgcuccgagcucaacaucgaguccugcuccaccaagugccagaccgagaucggcggcaucaacaccaacaaguccuuccacuccguccaccgcaacaccaucggcgacugccccaaguacgucaacgucaagucccucaagcucgccaccggccuccgcaacguccccgccaucgccucccgcggccucuucggcgccaucgccggcuucaucgagggcggcuggcccggccucaucaacggcugguacggcuuccagcaccgcaacgaggagggcaccggcaucgccgccgacaaggaguccacccagaaggccaucgaccagaucaccuccaaggucaacaacaucgucgaccgcaugaacaccaacuucgaguccguccagcacgaguccuccgagaucgaggagcgcaucaaccagcucuccaagcacgucgacgacuccauggucgacaucugguccuacaacgcccagcuccucguccuccucgagaacgagaagacccucgaccuccacgacuccaacguccgcaaccuccacgagaagguccgccgcaugcucaaggacaacgccaaggacgagggcaacggcugcuucaccuucuaccacaagugcgacaacaagugcaucgagcgcguccgcaacggcaccuacgaccacaaggaguucgaggaggaguccaagaucaaccgccaggagaucgagggcgucaagcucgacuccuccggcaacgucuacaagauccucuccaucuacuccugcaucgccuccucccucguccucgccgcccucaucaugggcuucauccucugggccugcuccaacggcuccugccgcugcaccaucugcaucuga

SEQ ID NO: 101847 - RNA, 1698 nt, Artificial Sequence
  derived and/or modified sequence opt2 from hemagglutinin__InfluenzaA__AGQ81203
augaagaagacccuccucuucgccgccaucuuccucuacgucaaggccgacgagaucugcaucggcuaccucuccaacaacuccaccgacaaggucgacaccaucaucgagaacaacgucaccgucaccuccuccgucgagcucgucgagaccgagcacaccggcuccuucugcuccaucaacggcaagcagcccaucucccucggcgacugcuccuucgccggcuggauccucggcaaccccaugugcgacgaccucaucggcaagaccuccugguccuacaucgucgagaagcccaaccccgccaacggcaucugcuaccccggcacccucgagaacgaggaggagcuccgccucaaguucuccggcguccucgaguucaacaaguucgaggccuucaccuccaacggcuggggcgccgucaacuccggcgccggcgucaccgccgccugcaaguucggcuccuccaacuccuucuuccgcaacauggucuggcucauccaccaguccggcaccuaccccgucaucaagcgcaccuucaacaacaccaagggccgcgacguccucgucgucuggggcauccaccaccccgccacccucaaggagcaccaggaccucuacaagaaggacuccuccuacgucgccgucggcuccgagaccuacaaccgccgcuucauccccgagaucuccacccgccccaaggucaacggccaggccggccgcaugaccuucuacuggaccaucgucaagcccggcgaguccaucaccuucgaguccaacggcgccuuccucgccccccgcuacgccuucgagaucgucuccgucggcaacggcaagcucuuccgcuccgagcucaacaucgaguccugcuccaccaagugccagaccgagaucggcggcaucaacaccaacaaguccuuccacuccguccaccgcaacaccaucggcgacugccccaaguacgucaacgucaagucccucaagcucgccaccggccuccgcaacguccccgccaucgccucccgcggccucuucggcgccaucgccggcuucaucgagggcggcuggcccggccucaucaacggcugguacggcuuccagcaccgcaacgaggagggcaccggcaucgccgccgacaaggaguccacccagaaggccaucgaccagaucaccuccaaggucaacaacaucgucgaccgcaugaacaccaacuucgaguccguccagcacgaguucuccgagaucgaggagcgcaucaaccagcucuccaagcacgucgacgacuccgucgucgacaucugguccuacaacgcccagcuccucguccuccucgagaacgagaagacccucgaccuccacgacuccaacguccgcaaccuccacgagaagguccgccgcaugcucaaggacaacgccaaggacgagggcaacggcugcuucaccuucuaccacaagugcgacaacgagugcaucgagcgcguccgcaacggcaccuacgaccacaaggaguucgaggaggaguccaagaucaaccgccaggagaucgagggcgucaagcucgacuccuccggcaacgucuacaagauccucuccaucuacuccugcaucgccuccucccucguccucgccgcccucaucaugggcuucauccucugggccugcuccaacggcuccugccgcugcaccaucugcaucuga

SEQ ID NO: 101848 - RNA, 1698 nt, Artificial Sequence
  derived and/or modified sequence opt2 from hemagglutinin__InfluenzaA__AGQ81204
augaagaagacccuccucuucgccgccaucuuccucuacgucaaggccgacgagaucugcaucggcuaccucuccaacaacuccaccgacaaggucgacaccaucaucgagaacaacgucaccgucaccuccuccgucgagcucgucgagaccgagcacaccggcuccuucugcuccaucaacggcaagcagcccaucucccucggcgacugcuccuucgccggcuggauccucggcaaccccaugugcgacgaccucaucggcaagaccuccugguccuacaucgucgagaagcccaaccccgccaacggcaucugcuaccccggcacccucgagaacgaggaggagcuccgccucaaguucuccggcguccucgaguucaacaaguucgaggccuucaccuccaacggcuggggcgccgucaacuccggcgccggcgucaccgccgccugcaaguucggcuccuccaacuccuucuuccgcaacauggucuggcucauccaccaguccggcaccuaccccgucaucaagcgcaccuucaacaacaccaagggccgcgacguccucgucgucuggggcauccaccaccccgccacccucaaggagcaccaggaccucuacaagaaggacuccuccuacgucgccgucggcuccgagaccuacaaccgccgcuucauccccgagaucuccacccgccccaaggucaacggccaggccggccgcaugaccuucuacuggaccaucgucaagcccggcgaguccaucaccuucgaguccaacggcgccuuccucgccccccgcuacgccuucgagaucgucuccgucggcaacggcaagcucuuccgcuccgagcucaacaucgaguccugcuccaccaagugccagaccgagaucggcggcaucaacaccaacaaguccuuccacuccguccaccgcaacaccaucggcgacugccccaaguacgucaacgucaagucccucaagcucgccaccggccuccgcaacguccccgccaucgccucccgcggccucuucggcgccaucgccggcuucaucgagggcggcuggcccggccucaucaacggcugguacggcuuccagcaccgcaacgaggagggcaccggcaucgccgccgacaaggaguccacccagaaggccaucgaccagaucaccuccaaggucaacaacaucgucgaccgcaugaacaccaacuucggcuccguccagcacgaguucuccgagaucgaggagcgcaucaaccagcucuccaagcacgucgacgacuccgucgucgacaucugguccuacaacgcccagcuccucguccuccucgagaacgagaagacccucgaccuccacgacuccaacguccgcaaccuccacgagaagguccgccgcaugcucaaggacaacgccaaggacgagggcaacggcugcuucaccuucuaccacaagugcgacaacgagugcaucgagcgcguccgcaacggcaccuacgaccacaaggaguucgaggaggaguccaagaucaaccgccaggagaucgagggcgucaagcucgacuccuccggcaacgucuacaagauccucuccaucuacuccugcaucgccuccucccucguccucgccgcccucaucaugggcuucauccucugggccugcuccaacggcuccugccgcugcaccaucugcaucuga

SEQ ID NO: 101849 - RNA, 1698 nt, Artificial Sequence
  derived and/or modified sequence opt2 from hemagglutinin__InfluenzaA__AGQ81205
augaagaagacccuccucuucgccgccaucuuccucuacgucaaggccgacgagaucugcaucggcuaccucuccaacaacuccaccgacaaggucgacaccaucaucgagaacaacgucaccgucaccuccuccgucgagcucgucgagaccgagcacaccggcuccuucugcuccaucaacggcaagcagcccaucucccucggcgacugcuccuucgccggcuggauccucggcaaccccaugugcgacgaccucaucggcaagaccuccugguccuacaucgucgagaagcccaaccccgccaacggcaucugcuaccccggcacccucgagaacgaggaggagcuccgccucaaguucuccggcguccucgaguucaacaaguucgaggccuucaccuccaacggcuggggcgccgucaacuccggcgccggcgucaccgccaccugcaaguucggcuccuccaacuccuucuuccgcaacauggucuggcucauccaccaguccggcaccuaccccgucaucaagcgcaccuucaacaacaccaagggccgcgacguccucgucgucuggggcauccaccaccccgccacccucaaggagcaccaggaccucuacaagaaggacuccuccuacgucgccgucggcuccgagaccuacaaccgccgcuucauccccgagaucuccacccgccccaaggucaacggccaggccggccgcaugaccuucuacuggaccaucgucaagcccggcgaguccaucaccuucgaguccaacggcgccuuccucgccccccgcuacgccuucgagaucgucuccgucggcaacggcaagcucuuccgcuccgagcucaacaucgaguccugcuccaccaagugccagaccgagaucggcggcaucaacaccaacaaguccuuccacuccguccaccgcaacaccaucggcgacugccccaaguacgucaacgucaagucccucaagcucgccaccggccuccgcaacguccccgccaucgccucccgcggccucuucggcgccaucgccggcuucaucgagggcggcuggcccggccucaucaacggcugguacggcuuccagcaccgcaacgaggagggcaccggcaucgccgccgacaaggaguccacccagaaggccaucgaccagaucaccuccaaggucaacaacaucgucgaccgcaugaacaccaacuucgaguccguccaguacgaguucuccgagaucgaggagcgcaucaaccagcucuccaagcacgucgacgacuccgucgucgacaucugguccuacaacgcccagcuccucguccuccucgagaacgagaagacccucgaccuccacgacuccaacguccgcaaccuccacgagaagguccgccgcaugcucaaggacaacgccaaggacgagggcaacggcugcuucaccuucuaccacaagugcgacaacgagugcaucgagcgcguccgcaacggcaccuacgaccacaaggaguucgaggaggaguccaagaucaaccgccaggagaucgagggcgucaagcucgacuccuccggcaacgucuacaagauccucuccaucuacuccugcaucgccuccucccucguccucgccgcccucaucaugggcuucauccucugggccugcuccaacggcuccugccgcugcaccaucugcaucuga

SEQ ID NO: 101850 - RNA, 1698 nt, Artificial Sequence
  derived and/or modified sequence opt2 from hemagglutinin__InfluenzaA__AGQ81206
augaagaagacccuccucuucgccgccaucuuccucuacgccaaggccgacgagaucugcaucggcuaccucuccaacaacuccaccgacaaggucgacaccaucaucgagaacaacgucaccgucaccuccuccgucgagcucgucgagaccgagcacaccggcuccuucugcuccaucaacggcaagcagcccaucucccucggcgacugcuccuucgccggcuggauccucggcaaccccaugugcgacgaccucaucggcaagaccuccugguccuacaucgucgagaagcccaaccccgccaacggcaucugcuaccccggcacccucgagaacgaggaggagcuccgcuccaaguucuccggcguccucgaguucuccaaguucgaggccuucaccuccaacggcuggggcgccgucaacuccggcgccggcgucaccgccgccugcaaguucggcuccuccaacuccuucuuccgcaacauggucuggcucauccaccaguccggcaccuaccccgucaucaagcgcaccuucaacaacaccaagggccgcgacguccucgucgucuggggcauccaccaccccgccacccucaaggagcaccaggaccucuacaagaaggacuccuccuacgucgccgucggcuccgagaccuacaaccgccgcuucauccccgagaucuccacccgccccaaggucaacggccaggccggccgcaugaccuucuacuggaccaucgucaagcccgaggaguccaucaccuucgaguccaacggcgccuuccucgccccccgcuacgccuucgagaucgucuccgucggcaacggcaagcucuuccgcuccgagcucaacaucgaguccugcuccaccaagugccagaccgagaucggcggcaucaacaccaacaaguccuuccacuccguccaccgcaacaccaucggcgacugccccaaguacgucaacgucaagucccucaagcucgccaccggccuccgcaacguccccgccaucgccucccgcggccucuucggcgccaucgccggcuucaucgagggcggcuggcccggccucaucaacggcugguacggcuuccagcaccgcaacgaggagggcaccggcaucgccgccgacaaggaguccacccagaaggccaucgaccagaucaccuccaaggucaacaacaucgucgaccgcaugaacaccaacuucgaguccguccagcacgaguucuccgagaucgaggagcgcaucaaccagcucuccaagcacgucgacgacuccgucgucgacaucugguccuacaacgcccagcuccucguccuccucgagaacgagaagacccucgaccuccacgacuccaacguccgcaaccuccacgagaagguccgccgcaugcucaaggacaacgccaaggacgagggcaacggcugcuucaccuucuaccacaagugcgacaacgagugcaucgagcgcguccgcaacggcaccuacgaccacaaggaguucgaggaggaguccaagaucaaccgccaggagaucgagggcgucaagcucgacuccuccggcaacgucuacaagauccucuccaucuacuccugcaucgccuccucccucauccucgccgcccucaucaugggcuucauccucugggccugcuccaacggcuccugccgcugcaccaucugcaucuga

SEQ ID NO: 101851 - RNA, 1698 nt, Artificial Sequence
  derived and/or modified sequence opt2 from hemagglutinin__InfluenzaA__AGQ81209
augaagaagacccuccucuucgccgccaucuuccucuacgucaaggccgacgagaucugcaucggcuaccucuccaacaacuccaccgacaaggucgacaccaucaucgagaacaacgucaccgucaccuccuccgucgagcucgucgagaccgagcacaccggcuccuucugcuccaucaacggcaagcagcccaucucccucggcgacugcuccuucgccggcuggauccucggcaaccccaugugcgacgaccucaucggcaagaccuccugguccuacaucgucgagaagcccaaccccgccaacggcaucugcuaccccggcacccucgagaacgaggaggagcuccgccucaaguucuccggcauccucgaguucuccaaguucgaggccuucaccuccaacggcuggggcgccgucaacuccggcgccggcgucaccgccgccugcaaguucggcuccuccaacuccuucuuccgcaacauggucuggcucauccaccaguccggcaccuaccccgucaucaagcgcaccuucaacaacaccaagggccgcgacguccucaucgucuggggcauccaccaccccgccacccucaaggagcaccaggaccucuacaagaaggacuccuccuacgucgccgucggcuccgagaccuacaaccgccgcuucauccccgagaucuccacccgccccaaggucaacggccaggccggccgcaugaccuucuacuggaccaucgucaagcccggcgaguccaucaccuucgaguccaacggcgccuuccucgccccccgcuacgccuucgagaucgucuccgucggcaacggcaagcucuuccgcuccgagcucaacaucgaguccugcuccaccaagugccagaccgagaucggcggcaucaacaccaacaaguccuuccacuccguccaccgcaacaccaucggcgacugccccaaguacgucaacgucaagucccucaagcucgccaccggccuccgcaacguccccgccaucgccucccgcggccucuucggcgccaucgccggcuucaucgagggcggcuggcccggccucaucaacggcugguacggcuuccagcaccgcaacgaggagggcaccggcaucgccgccgacaaggaguccacccagaaggccaucgaccagaucaccuccaaggucaacaacaucgucgaccgcaugaacaccaacuucgaguccguccagcacgaguucuccgagaucgaggagcgcaucaaccagcucuccaagcacgucgacgacuccgucgucgacaucugguccuacaacgcccagcuccucguccuccucgagaacgagaagacccucgaccuccacgacuccaacguccgcaaccuccacgagaagguccgccgcaugcucaaggacaacgccaaggacgagggcaacggcugcuucaccuucuaccacaagugcgacaacgagugcaucgagcgcguccgcaacggcaccuacgaccacaaggaguucgaggaggaguccaagaucaaccgccaggagaucgagggcgucaagcucgacuccuccggcaacgucuaccgcauccucuccaucuacuccugcaucgccuccucccucguccucgccgcccucaucaugggcuucauccucugggccugcuccaacggcuccugccgcugcaccaucugcaucuga

SEQ ID NO: 101852 - RNA, 1698 nt, Artificial Sequence
  derived and/or modified sequence opt2 from hemagglutinin__InfluenzaA__AGQ81211
augaagaagacccuccucuucgccgccaucuuccucuacgucaaggccgacgagaucugcaucggcuaccucuccaacaacuccaccgacaaggucgacaccaucaucgagaacaacgucaccgucaccuccuccgucgagcucgucgagaccgagcacaccggcuccuucugcuccaucaacggcaagcagcccaucucccucggcgacugcuccuucgccggcuggauccucggcaaccccaugugcgacgaccucaucggcaagaccuccugguccuacaucgucgagaagcccaaccccgccaacggcaucugcuaccccggcacccucgagaacgaggaggagcuccgccucaaguucuccggcguccucgaguucuccaaguucgaggccuucaccuccaacggcuggggcgccgucaacuccggcgccggcgucaccgccgccugcaaguucggcuccuccaacuccuucuuccgcaacauggucuggcucauccaccaguccggcaccuaccccgucaucaagcgcaccuucaacaacaccaagggccgcgacguccucaucgucuggggcauccaccaccccgccacccucaaggagcaccaggaccucuacaagaaggacuccuccuacgucgccgucggcuccgagaccuacaaccgccgcuucauccccgagaucuccacccgccccaaggucaacggccaggccggccgcaugaccuucuacuggaccaucgucaagcccggcgaguccaucaccuucgaguccaacggcgccuuccucgccccccgcuacgccuucgagaucgucuccgucggcaacggcaagcucuuccgcuccgagcucaacaucgaguccugcuccaccaagugccagaccgagaucggcggcaucaacaccaacaaguccuuccacuccguccaccgcaacaccaucggcgacugccccaaguacgucaacgucaagucccucaagcucgccaccggccuccgcaacguccccgccaucgccucccgcggccucuucggcgccaucgccggcuucaucgagggcggcuggcccggccucaucaacggcugguacggcuuccagcaccgcaacgaggagggcaccggcaucgccgccgacaaggaguccacccagaaggccaucgaccagaucaccuccaaggucaacaacaucgucgaccgcaugaacaccaacuucgaguccguccagcacgaguucuccgagaucgaggagcgcaucaaccagcucuccaagcacgucgacgacuccgucgucgacaucugguccuacaacgcccagcuccucguccuccucgagaacgagaagacccucgaccuccacgacuucaacguccgcaaccuccacgagaagguccgccgcaugcucaaggacaacgccaaggacgagggcaacggcugcuucaccuucuaccacaagugcgacaacgagugcaucgagcgcguccgcaacggcaccuacgaccacaaggaguucgaggaggaguccaagaucaaccgccaggagaucgagggcgucaagcucgacuccuccggcaacgucuaccgcauccucuccaucuacuccugcaucgccuccucccucguccucgccgcccucaucaugggcuucauccucugggccugcuccaacggcuccugccgcugcaccaucugcaucuga

SEQ ID NO: 101853 - RNA, 1698 nt, Artificial Sequence
  derived and/or modified sequence opt2 from hemagglutinin__InfluenzaA__AGQ81213
augaagaagacccuccucuucgccgccaucuuccucuacguccgcgccgacgagaucugcaucggcuaccucuccaacaacuccaccgacaaggucgacaccaucaucgagaacaacgucaccgucaccuccuccgucgagcucgucgagaccgagcacaccggcuccuucugcuccaucaacggcaagcagcccaucucccucggcgacugcuccuucgccggcuggauccucggcaaccccaugugcgacggccucaucggcaagaccuccugguccuacaucgucgagaagcccaaccccgccaacggcaucugcuaccccggcacccucgagaacgaggaggagcuccgccucaaguucucccgcguccucgaguucuccaaguucgaggccuucaccuccaacggcuggggcgccgucaacuccggcgccggcgucaccgccgccugcaaguucggcuccuccaacuccuucuuccgcaacauggucuggcucauccaccaguccggcaccuaccccgucaucaagcgcaccuucaacaacaccaagggccgcgacguccucgucgucuggggcauccaccaccccgccacccucaaggagcaccaggaccucuacaagaaggacuccuccuacgucgccgucggcuccgagaccuacaaccgccgcuucauccccgagaucuccacccgccccaccgucaacggccaggccggccgcaugaccuucuacuggaccaucgucaagcccggcgaguccaucaccuucgaguccaacggcgccuuccucgccccccgcuacgccuucgagaucgucuccgucggcaacggcaagcucuuccgcuccgagcucaacaucgaguccugcuccaccaagugccagaccgagaucggcggcaucaacaccaacaaguccuuccacuccguccaccgcaacaccaucggcgacugccccaaguacgucaacgucaagucccucaagcucgccaccggccuccgcaacguccccgccaucgccucccgcggccucuucggcgccaucgccggcuucaucgagggcggcuggcccggccucaucaacggcugguacggcuuccagcaccgcaacgaggagggcaccggcaucgccgccgacaaggaguccacccagaaggccaucgaccagaucaccuccaaggucaacaacaucgucgaccgcaugaacaccaacuucgaguccguccagcacgaguucuccgagaucgaggagcgcaucaaccagcucuccaagcacgucgacgacuccgucgucgacaucugguccuacaacgcccagcuccucguccuccucgagaacgagaagacccucgaccuccacgacuccaacguccgcaaccuccacgagaagguccgccgcaugcucaaggacaacgccaaggacgagggcaacggcugcuucaccuucuaccacaagugcgacaacgagugcaucgagcgcguccgcaacggcaccuacgaccacaaggaguucgaggaggaguccaagaucaaccgccaggagaucgagggcgucaagcucgacuccuccggcaacgucuacaagauccucuccaucuacuccugcaucgccuccucccucguccucgccgcccucaucaugggcuucauccucugggccugcuccaacggcuccugccgcugcaccaucugcaucuga

SEQ ID NO: 101854 - RNA, 1698 nt, Artificial Sequence
  derived and/or modified sequence opt2 from hemagglutinin__InfluenzaA__AGQ81214
augaagaagacccuccucuucgccgccaucuuccucuacgucaaggccgacgagaucugcaucggcuaccucuccaacaacuccaccgacaaggucgacaccaucaucgagaacaacgucaccgucaccuccuccgucgagcucgucgagaccgagcacaccggcuccuucugcuccaucaacggcaagcagcccaucucccucggcgacugcuccuucgccggcuggauccucggcaaccccaugugcgacgaccucaucggcaagaccuccugguccuacaucgucgagaagcccaaccccgccaacggcaucugcuaccccggcacccucgagaacgaggaggagcuccgccucaaguucuccggcguccucgaguucuccaaguucgaggccuucaccuccaacggcuggggcgccgucaacuccggcgccggcgucaccgccgccugcaaguucggcuccuccaacuccuucuuccgcaacauggucuggcucauccaccaguccggcaccuaccccgucaucaagcgcaccuucaacaacaccaagggccgcgacguccucaucgucuggggcauccaccaccccgccacccucaaggagcaccaggaccucuacaagaaggacuccuccuacgucgccgucggcuccgagaccuacaaccgccgcuucauccccgagaucuccacccgccccaaggucaacggccaggccggccgcaugaccuucuacuggaccaucgucaagcccggcgaguccaucaccuucgaguccaacggcgccuuccucgccccccgcuacgccuucgagaucgucuccgucggcaacggcaagcucuuccgcuccgagcucaacaucgaguccugcuccaccaagugccagaccgagaucggcggcaucaacaccaacaaguccuuccacuccguccaccgcaacaccaucggcgacugccccaaguacgucaacgucaagucccucaagcucgccaccggccuccgcaacguccccgccaucaccucccgcggccucuucggcgccaucgccggcuucaucgagggcggcuggcccggccucaucaacggcugguacggcuuccagcaccgcaacgaggagggcaccggcaucgccgccgacaaggaguccacccagaaggccaucgaccagaucaccuccaaggucaacaacaucgucgaccgcaugaacaccaacuucgaguccguccagcacgaguucuccgagaucgagggccgcaucaaccagcucuccaagcacgucgacgacuccgucgucgacaucugguccuacaacgcccagcuccucguccuccucgagaacgagaagacccucgaccuccacgacuccaacguccgcaaccuccacgagaagguccgccgcaugcucaaggacaacgccaaggacgagggcaacggcugcuucaccuucuaccacaagugcgacaacgagugcaucgagcgcguccgcaacggcaccuacgaccacaaggaguucgaggaggaguccaagaucaaccgccaggagaucgagggcgucaagcucgacuccuccggcaacgucuacaagauccucuccaucuacuccugcaucgccuccucccucguccucgccgcccucaucaugggcuucauccucugggccugcuccaacggcuccugccgcugcaccaucugcaucuga

SEQ ID NO: 101855 - RNA, 1698 nt, Artificial Sequence
  derived and/or modified sequence opt2 from hemagglutinin__InfluenzaA__AGQ81215
augaagaagacccuccucuucgccgccaucuuccucuacgucaaggccgacgagaucugcaucggcuaccucuccaacaacuccaccgacaaggucgacaccaucaucgagaacaacgucaccgucaccuccuccgucgagcucgucgagaccgagcacaccggcuccuucugcuccaucaacggcaagcagcccaucucccucggcgacugcuccuucgccggcuggauccucggcaaccccaugugcgacggccucaucggcaagaccuccugguccuacaucgucgagaagcccaaccccgccaacggcaucugcuaccccggcacccucgagaacgaggaggagcuccgccucaaguucuccggcauccucgaguucuccaaguucgaggccuucaccuccaacggcuggggcgccgucaacuccggcgccggcgucaccgccgccugcaaguucggcuccuccaacuccuucuuccgccacauggucuggcucauccaccaguccggcaccuaccccgucaucaagcgcaccuucaacaacaccaagggccgcgacguccucgucgucuggggcauccaccaccccgccacccucaaggagcagcaggaccucuacaagaaggacuccuccuacgucgccgucggcuccgagaccuacaaccgccgcuucauccccgagaucuccacccgccccaaggucaacggccaggccggccgcaugaccuucuacuggaccaucgucaagcccggcgaguccaucaccuucgaguccaacggcgccuuccucgccccccgcuacgccuucgagaucgucuccgucggcaacggcaagcucuuccgcuccgagcucaacaucgaguccugcuccaccaagugccagaccgagaucggcggcaucaacaccaacaaguccuuccacuccguccaccgcaacaccaucggcgacugccccaaguacgucaacgucaagucccucaagcucgccaccggccuccgcaacguccccgccaucgccucccgcggccucuucggcgccaucgccggcuucaucgagggcggcuggcccggccucaucaacggcugguacggcuuccagcaccgcaacgaggagggcaccggcaucgccgccgacaaggaguccacccagaaggccaucgaccagaucaccuccaaggucaacaacaucgucgaccgcaugaacaccaacuucgaguccguccagcacgaguucuccgagaucgaggagcgcaucaaccagcucuccaagcacgucgacgacuccgucgucgacaucugguccuacaacgcccagcuccucguccuccucgagaacgagaagacccucgaccuccacgacuccaacguccgcaaccuccacgagaagguccgccgcaugcucaaggacaacgccaaggacgagggcaacggcugcuucaccuucuaccacaagugcgacaacgagugcaucgagcgcguccgcaacggcaccuacgaccacaaggaguucgaggaggaguccaagaucaaccgccaggagaucgagggcgucaagcucgacuccuccggcaacgucuacaagauccucuccaucuacuccugcaucgccuccucccucguccucgccgcccucaucaugggcuucauccucugggccugcuccaacggcuccugccgcugcaccaucugcaucuga

SEQ ID NO: 101856 - RNA, 1698 nt, Artificial Sequence
  derived and/or modified sequence opt2 from hemagglutinin__InfluenzaA__AGQ81216
augaagaagacccuccucuucgccgccaucuuccucuacgucaaggccgacgagaucugcaucggcuaccucuccaacaacuccaccgacaaggucgacaccaucaucgagaacaacgucaccgucaccuccuccgucgagcucgucgagaccgagcacaccggcuccuucugcuccaucaacggcaagcagcccaucucccucggcgacugcuccuucgccggcuggauccucggcaaccccaugugcgacgaccucaucggcaagaccuccugguccuacaucgucgagaagcccaaccccgccaacggcaucugcuaccccggcacccucgagaacgaggaggagcuccgccucaaguucuccggcguccucgaguucuccaaguucgaggccuucaccuccaacggcuggggcgccgucaacuccggcgccggcgucaccgccgccugcaaguucggcuccuccaacuccuucuuccgcaacauggucuggcucauccaccaguccggcaccuaccccgucaccaagcgcaccuucaacaacaccaagggccgcgacguccucgucgucuggggcauccaccaccccgccacccucaaggagcaccaggaccucuacaagaaggacuccuccuacgucgccgucggcuccgagaccuacaaccgccgcuucacccccgagaucuccacccgccccaaggucaacggccaggccggccgcaugaccuucuacuggaccaucgucaagcccggcgaguccaucaccuucgaguccaacggcgccuuccucgccccccgcuacgccuucgagaucgucuccgucggcaacggcaagcucuuccgcuccgagcucaacaucgaguccugcuccaccaagugccagaccgagaucggcggcaucaacaccaacaaguccuuccacuccguccaccgcaacaccaucggcgacugccccaaguacgucaacgucaagucccucaagcucgccaccggccuccgcaacguccccgccaucgccuccaagggccucuucggcgccaucgccggcuucaucgagggcggcuggcccggccucaucaacggcugguacggcuuccagcaccgcaacgaggagggcaccggcaucgccgccgacaaggaguccacccagaaggccaucgaccagaucaccuccaaggucaacaacaucgucgaccgcaugaacaccaacuucgaguccguccgccacgaguucuccgagaucgaggagcgcaucaaccagcucuccaagcacgucgacgacuccgucgucgacaucugguccuacaacgcccagcuccucguccuccucgagaacgagaagacccucgaccuccacgacuccaacguccgcaaccuccacgagcgcguccgccgcaugcucaaggacaacgccaaggacgagggcaacggcugcuucaccuucuaccacaagugcgacaacgagugcaucgagcgcguccgcaacggcaccuacgaccacaaggaguucgaggaggaguccaagaucaaccgccaggagaucgagggcgucaagcucgacuccuccggcaacgucuacaagauccucuccaucuacuccugcaucgccuccucccucguccucgccgcccucaucaugggcuucauccucugggccugcggcaacggcuccugccgcugcaccaucugcaucuga

SEQ ID NO: 101857 - RNA, 1698 nt, Artificial Sequence
  derived and/or modified sequence opt2 from hemagglutinin__InfluenzaA__AGQ81217
augaagaagacccuccucuucgccgccaucuuccucuacgccaaggccgacgagaucugcaucggcuaccucuccaacaacuccaccgacaaggucgacaccaucaucgagaacaacgucaccgucaccuccuccgucgagcucgucgagaccgagcacaccggcuccuucugcuccaucaacggcaagcagcccaucucccucggcgacugcuccuucgccggcuggauccucggcaaccccaugugcgacgaccucaucggcaagaccuccugguccuacaucgucgagaagcccaaccccgccaacggcaucugcuaccccggcacccucgagaacgaggaggagcuccgccucaaguucuccggcguccucgaguucucccgcuucgaggccuucaccuccaacggcuggggcgccgucaacuccggcgccggcgucaccgccgccugcaaguucggcuccuccaacuccuucuuccgcaacauggucuggcucauccaccaguccggcaccuaccccgucaucaagcgcaccuucaacaacaccaagggccgcgacguccucgucgucuggggcauccaccaccccgccacccucaaggagcaccaggaccucuacaagaaggacuccuccuacgucgccgucggcuccgagaccuacaaccgccgcuucauccccgagaucuccacccgccccaaggucaacggccaggccggccgcaugaccuucuacuggaccaucgucaagcccgaggaguccaucaccuucgaguccaacggcgccuuccucgccccccgcuacgccuucgagaucgucuccgucggcaacggcaagcucuuccgcuccgagcucaacaucgaguccugcuccaccaagugccagaccgagaucggcggcaucaacaccaacaaguccuuccacuccguccaccgcaacaccaucggcgacugccccaaguacgucaacgucaagucccucaagcucgccaccggccuccgcaacguccccgccaucgccucccgcggccucuucggcgccaucgccggcuucaucgagggcggcuggcccggccucaucaacggcugguacggcuuccagcaccgcaacgaggagggcaccggcaucgccgccgacaaggaguccacccagaaggccaucgaccagaucaccuccaaggucaacaacaucgucgaccgcaugaacaccaacuucgaguccguccagcacgaguucuccgagaucgaggagcgcaucaaccagcucuccaagcacgucgacgacuccgucgucgacaucugguccuacaacgcccagcuccucguccuccucgagaacgagaagacccucgaccuccacgacuccaacguccgcaaccuccacgagaagguccgccgcaugcucaaggacaacgccaaggacgagggcaacggcugcuucaccuucuaccacaagugcgacaacgagugcaucgagcgcguccgcaacggcaccuacgaccacaaggaguucgaggaggaguccaagaucaaccgccaggagaucgagggcgucaagcucgacuccuccggcaacgucuacaagauccucuccaucuacuccugcaucgccuccucccucauccucgccgcccucaucaugggcuucauccucugggccugcuccaacggcuccugccgcugcaccaucugcaucuga

SEQ ID NO: 101858 - RNA, 1704 nt, Artificial Sequence
  derived and/or modified sequence opt2 from hemagglutinin__InfluenzaA__AGQ88499
auggagaagaucguccuccucuucgccaccaucucccucgucaaguccgaccacaucugcaucggcuaccacgccaacaacuccaccgagcaggucgacaccaucauggagaagaacgucaccgucacccacgcccaggacauccucgagaagacccacaacggcaagcucugcgaccucaacggcgucaagccccucauccucaaggacugcuccgucgccggcuggcuccucggcaaccccaugugcgacgaguucaucaacguccccgagugguccuacaucgucgagaaggccaaccccgccaacgaccucugcuaccccggcaacuucaacgacuacgaggagcucaagcaccuccucucccgcaucaaccacuucgagaagauccagaucauccccaaggacuccuggaccgaccacgaggccucccucggcgucuccgccgccugccccuaccagggcaacuccuccuucuuccgcaacgucgucuggcucaucaagaaggacaacgccuaccccaccaucaagaagggcuacaacaacaccaaccaggaggaccuccucguccucuggggcauccaccaccccaacaacgaggccgagcagacccgccucuaccagaaccccaccaccuacaucuccaucggcaccuccacccucaaccagcgccucguccccaagaucgccacccgcuccaagaucaacggccaguccggccgcaucgacuucuucuggaccauccucaagcccaacgacgccauccacuucgaguccaacggcaacuucaucgcccccgaguacgccuacaagaucgucaagaagggcgacuccaccaucaugaaguccgaggucgaguacggcaacugcaacacccgcugccagacccccaucggcgccaucaacuccuccaugcccuuccacaacauccacccccucaccaucggcgagugccccaaguacgucaaguccaacaagcucguccucgccaccggccuccgcaacuccccccagcgcgagcgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuaccacgacuccaacguccgcaaccucuacgacaagguccgccuccagcucaaggacaacgccaaggagcucggcaacggcugcuucgaguucuaccacaagugcaacaacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucguccucgccaucaugauggccggccucucccucuggaugugcuccaacggcucccuccagugccgcaucugcaucuga

SEQ ID NO: 101859 - RNA, 1683 nt, Artificial Sequence; identical to SEQ ID NO: 101749
  derived and/or modified sequence opt2 from hemagglutinin__InfluenzaA__AGR33888

SEQ ID NO: 101860 - RNA, 1683 nt, Artificial Sequence; identical to SEQ ID NO: 101749
  derived and/or modified sequence opt2 from hemagglutinin__InfluenzaA__AGR33889

SEQ ID NO: 101861 - RNA, 1683 nt, Artificial Sequence
  derived and/or modified sequence opt2 from hemagglutinin__InfluenzaA__AGR33890
augaacacccagauccucgucuucgcccucaucgccaucacccccaccaacuccgacaagaucugccucggccaccacgccgucuccaacggcaccaaggucaacacccucaccgagcgcggcgucgaggucgucaacgccaccgagaccgucgagcgcaccuccaucccccgcaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggaggccaugggcuucaccuacuccggcauccgcaccaacggcgccaccuccgccugccgccgcuccggcuccuccuucuacgccgagaugaaguggcuccucuccaacaccgacaacgccgccuucccccccaugaccaaguccuacaagaacacccgcaaggcccccgcccucaucaucuggggcauccaccacuccgucuccaccgccgagcagaccaagcucuacggcuccggcaacaagcucgucaccguccgcuccuccaacuaccagcaguccuucguccccucccccggcgccggcccccaggucaacggccaguccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacuccggcggcaccaucaucuccaaccuccccuuccagaacaucgacucccgcgucgucggcaagugcccccgcuacgucaagcagaagucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucaaccagaugaccggcaagcucaaccgccucaucgagaagaccaaccagcaguucgagcucaucgacaacgaguucaccgaggucgagaagcagaucggcaacgucaucaacuggacccgcgacuccaucaccgaggucugguccuacaacgccgagcuccucgucgccauggagaaccagcacaccaucgaccucgccgacuccgagaugaacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgccaugggccucgucuucaucugcgucaagaacggcaacaugcgcugcaccaucugcaucuga

SEQ ID NO: 101862 - RNA, 1683 nt, Artificial Sequence
  derived and/or modified sequence opt2 from hemagglutinin__InfluenzaA__AGR33892
augaacacccagauccucgucuucgcccucaucgccaucauccccaccaacgccgacaagaucugccucggccaccacgccgucuccaacggcaccaaggucaacacccucaccgagcgcggcgucgaggucgucaacgccaccgagaccgucgagcgcaccuccaucccccgcaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucaacaaggaggccaugggcuucaccuacuccggcauccgcaccaacggcgccaccuccgccugccgccgcuccggcuccuccuucuacgccgagaugaaguggcuccucuccaacaccgacaacgccgccuucccccccaugaccaaguccuacaagaacacccgcaaggcccccgcccucaucaucuggggcauccaccacuccggcuccaccgccgagcagaccaagcucuacggcuccggcaacaagauggucaccguccgcuccuccaacuaccagcaguccuucguccccucccccggcgccggcccccaggucaacggccaguccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacuccggcggcaccaucaucuccaaccuccccuuccagaacaucgacucccgcgucgucggcaagugcccccgcuacgucaagcagaagucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucaaccagaugaccggcaagcucaaccgccucaucgagaagaccaaccagcaguucgagcucaucgacaacgaguucaccgaggucgagaagcagaucggcaacgucaucaacuggacccgcgacuccaucaccgaggucugguccuacaacgccgagcuccucgucgccauggagaaccagcacaccaucgaccucgccgacuccgagaugaacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgccaugggccucgucuucaucugcgucgagaacggcaacaugcgcugcaccaucugcaucuga

SEQ ID NO: 101863 - RNA, 1683 nt, Artificial Sequence; identical to SEQ ID NO: 101741
  derived and/or modified sequence opt2 from hemagglutinin__InfluenzaA__AGR33895

SEQ ID NO: 101864 - RNA, 1683 nt, Artificial Sequence; identical to SEQ ID NO: 101820
  derived and/or modified sequence opt2 from hemagglutinin__InfluenzaA__AGR33897

SEQ ID NO: 101865 - RNA, 1683 nt, Artificial Sequence
  derived and/or modified sequence opt2 from hemagglutinin__InfluenzaA__AGR33899
auggagaccgucucccucaucaccauccuccucgucgccaccgucuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccucccucggccagccccucauccucgacaccugcaccaucgagggccucaucuacggcaaccccuccugcgaccuccuccucgagggccgcgagugguccuacaucgucgagcgccccuccgccgucaacggccucugcuaccccggcaacgucgagaaccucgaggagcuccgcucccucuucuccuccgcccgcuccuaccagcgcauccagaucuuccccgacaccaucuggaacgucuccuacaacggcaccuccaaggccugcuccggcuccuucuaccgcuccaugcgcuggcucacccagaagaacuccaacuaccccauccaggacgcccaguacaccaacaaccagggcaagaacauccucuucauguggggcaucaaccacccccccaccgacaccacccagcgcgaccucuacacccgcaccgacaccaccaccuccgucgccaccgaggagaucaaccgcaucuucaagccccucaucggcccccgcccccucgucaacggccucaugggccgcaucgacuacuacugguccguccucaagcccggccagacccuccgcaucaaguccgacggcaaccucaucgcccccugguacggccacauccucuccggcgagucccacggccgcauccucaagaccgaccucaagaagggcuccugcaccguccagugccagaccgagaagggcggccucaacaccacccuccccuuccagaacgucuccaaguacgccuucggcaacugcuccaaguacaucggcaucaagucccucaagcucgccgucggccuccgcaacguccccucccgcuccucccgcggccucuucggcgccaucgccggcuucaucgagggcggcugguccggccucgucgccggcugguacggcuuccagcacuccaacgaccagggcgucggcauggccgccgaccgcgacuccacccagaaggccaucgacaagaucaccuccaaggucaacaacaucgucgacaagaugaacaagcaguacgagaucaucgaccacgaguucuccgaggucgagacccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgagcucuaccacaagugcgacgaccagugcauggagaccauccgcaacggcaccuacaaccgcuccaaguaccaggaggaguccaagcucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 101866 - RNA, 1683 nt, Artificial Sequence
  derived and/or modified sequence opt2 from hemagglutinin__InfluenzaA__AGR33900
auggagaccgucucccucaucaccauccuccucgucgccaccgucuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccucccucggccagccccucauccucgacaccugcaccaucgagggccucaucuacggcaaccccuccugcgaccuccuccucgagggccgcgagugguccuacaucgucgagcgccccuccgccgucaacggccucugcuaccccggcaacgucgagaaccucgaggagcuccgcucccucuucuccuccgcccgcuccuaccagcgcauccagaucuuccccgacaccaucuggaacgucuccuacaacggcaccuccaaggccugcuccggcuccuucuaccgcuccaugcgcuggcucacccagaagaacuccgacuaccccauccaggacgcccaguacaccaacaaccagggcaagaacauccucuucauguggggcaucaaccacccccccaccgacaccacccagcgcgaccucuacacccgcaccgacaccaccaccuccgucgccaccgaggagaucaaccgcaucuucaagccccucaucggcccccgcccccucgucaacggccucaugggccgcaucgacuacuacugguccguccucaagcccggccagacccuccgcaucaaguccgacggcaaccucaucgcccccugguacggccacauccucuccggcgagucccacggccgcauccucaagaccgaccucaagaagggcuccugcaccguccagugccagaccgagaagggcggccucaacaccacccuccccuuccagaacgucuccaaguacgccuucggcaacugcuccaaguacaucggcaucaagucccucaagcucgccgucggccuccgcaacguccccucccgcuccucccgcggccucuucggcgccaucgccggcuucaucgagggcggcugguccggccucgucgccggcugguacggcuuccagcacuccaacgaccagggcgucggcauggccgccgaccgcgacuccacccagaaggccaucgacaagaucaccuccaaggucaacaacaucgucgacaagaugaacaagcaguacgagaucaucgaccacgaguucuccgaggucgagacccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgaccucuaccacaagugcgacgaccagugcauggagaccauccgcaacggcaccuacaaccgccgcaaguaccaggaggaguccaagcucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 101867 - RNA, 1683 nt, Artificial Sequence
  derived and/or modified sequence opt2 from hemagglutinin__InfluenzaA__AGR33902
auggagaccgccucccucaucaccauccuccucgucgccaccgucuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccucccucggccagccccucauccucgacaccugcaccaucgagggccucaucuacggcaaccccuccugcgaccuccuccucgagggccgcgagugguccuacaucgucgagcgccccuccgccgucaacggccucugcuaccccggcaacgucgagaaccucgaggagcuccgcucccucuucuccuccgcccgcuccuaccagcgcauccagaucuuccccgacaccaccuggaacgucuccuacaacggcaucuccaaggccugcuccggcuccuucuaccgcuccaugcgcuggcucacccagaagaacuccaacuaccccauccaggacgcccaguacaccaacaaccagggcaagaacauccucuucauguggggcaucaaccacccccccaccgacaccacccagcgcgaccucuacacccgcaccgacaccaccaccuccgucgccaccgaggagaucaaccgcaucuucaagccccucaucggcccccgcccccucgucaacggccucaugggccgcaucgacuacuacugguccguccucaagcccggccagacccuccgcaucaaguccgacggcaaccucaucgcccccugguacggccacauccucuccggcgagucccacggccgcauccucaagaccgaccucaagcgcggcuccugcaccguccagugccagaccgagaagggcggccucaacaccacccuccccuuccagaacgucuccaaguacgccuucggcaacugcuccaaguacaucggcaucaagucccucaagcucgccgucggccuccgcaacguccccucccgcuccucccgcggccucuucggcgccaucgccggcuucaucgagggcggcugguccggccucgucgccggcugguacggcuuccagcacuccaacgaccagggcgucggcauggccgccgaccgcgacuccacccagaaggccaucgacaagaucaccuccaaggucaacaacaucgucgacaagaugaacaagcaguacgagaucaucgaccacgaguucuccgaggucgagacccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgagcucuaccacaagugcgacaaccagugcauggagaccauccgcaacggcaccuacaaccgccgcaaguaccaggaggaguccaagcucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 101868 - RNA, 1698 nt, Artificial Sequence; identical to SEQ ID NO: 97025
  derived and/or modified sequence opt2 from hemagglutinin__InfluenzaA__AGR49817

SEQ ID NO: 101869 - RNA, 1698 nt, Artificial Sequence
  derived and/or modified sequence opt2 from hemagglutinin__InfluenzaA__AGR49841
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagccccgcgacaccaucaucuucgaggccaacggcaaccucaucgccccccgcuacgccuucgcccucucccgcggcuucggcuccggcaucaucaacuccaacgcccccaugggcaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaucggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 101870 - RNA, 1698 nt, Artificial Sequence; identical to SEQ ID NO: 97025
  derived and/or modified sequence opt2 from hemagglutinin__InfluenzaA__AGR49853

SEQ ID NO: 101871 - RNA, 1698 nt, Artificial Sequence
  derived and/or modified sequence opt2 from hemagglutinin__InfluenzaA__AGR49865
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacaaccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucgucaaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucaaccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacgucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 101872 - RNA, 1701 nt, Artificial Sequence; identical to SEQ ID NO: 94168
  derived and/or modified sequence opt2 from hemagglutinin__InfluenzaA__AGR49877

SEQ ID NO: 101873 - RNA, 1701 nt, Artificial Sequence; identical to SEQ ID NO: 93946
  derived and/or modified sequence opt2 from hemagglutinin__InfluenzaA__AGR49888

SEQ ID NO: 101874 - RNA, 1701 nt, Artificial Sequence
  derived and/or modified sequence opt2 from hemagglutinin__InfluenzaA__AGR49900
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaagugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101875 - RNA, 1701 nt, Artificial Sequence
  derived and/or modified sequence opt2 from hemagglutinin__InfluenzaA__AGR49912
augaagaccaucaucgcccucuccuacauccucugccucgucuccgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccaagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101876 - RNA, 1701 nt, Artificial Sequence
  derived and/or modified sequence opt2 from hemagglutinin__InfluenzaA__AGR49924
augaagaccaucaucgcccucuccuacauccucugccucgucuccgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccaagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccgucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101877 - RNA, 1701 nt, Artificial Sequence
  derived and/or modified sequence opt2 from hemagglutinin__InfluenzaA__AGR49936
augaagaccaucaucgcccucuccuacauccucugccucaucuccgcccagaaguuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccggcuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101878 - RNA, 1701 nt, Artificial Sequence; identical to SEQ ID NO: 99206
  derived and/or modified sequence opt2 from hemagglutinin__InfluenzaA__AGR49948

SEQ ID NO: 101879 - RNA, 1701 nt, Artificial Sequence; identical to SEQ ID NO: 94039
  derived and/or modified sequence opt2 from hemagglutinin__InfluenzaA__AGR49960

SEQ ID NO: 101880 - RNA, 1701 nt, Artificial Sequence
  derived and/or modified sequence opt2 from hemagglutinin__InfluenzaA__AGR49972
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggaccaucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101881 - RNA, 1698 nt, Artificial Sequence; identical to SEQ ID NO: 98210
  derived and/or modified sequence opt2 from hemagglutinin__InfluenzaA__AGR49983

SEQ ID NO: 101882 - RNA, 1698 nt, Artificial Sequence; identical to SEQ ID NO: 98210
  derived and/or modified sequence opt2 from hemagglutinin__InfluenzaA__AGR49995

SEQ ID NO: 101883 - RNA, 1701 nt, Artificial Sequence; identical to SEQ ID NO: 94168
  derived and/or modified sequence opt2 from hemagglutinin__InfluenzaA__AGR50007

SEQ ID NO: 101884 - RNA, 1701 nt, Artificial Sequence; identical to SEQ ID NO: 94168
  derived and/or modified sequence opt2 from hemagglutinin__InfluenzaA__AGR50018

SEQ ID NO: 101885 - RNA, 1701 nt, Artificial Sequence; identical to SEQ ID NO: 94168
  derived and/or modified sequence opt2 from hemagglutinin__InfluenzaA__AGR50029

SEQ ID NO: 101886 - RNA, 1701 nt, Artificial Sequence
  derived and/or modified sequence opt2 from hemagglutinin__InfluenzaA__AGR50040
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaugggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101887 - RNA, 1701 nt, Artificial Sequence; identical to SEQ ID NO: 94168
  derived and/or modified sequence opt2 from hemagglutinin__InfluenzaA__AGR50052

SEQ ID NO: 101888 - RNA, 1701 nt, Artificial Sequence; identical to SEQ ID NO: 94168
  derived and/or modified sequence opt2 from hemagglutinin__InfluenzaA__AGR50063

SEQ ID NO: 101889 - RNA, 1701 nt, Artificial Sequence
  derived and/or modified sequence opt2 from hemagglutinin__InfluenzaA__AGR50074
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcaaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101890 - RNA, 1701 nt, Artificial Sequence; identical to SEQ ID NO: 94168
  derived and/or modified sequence opt2 from hemagglutinin__InfluenzaA__AGR50085

SEQ ID NO: 101891 - RNA, 1701 nt, Artificial Sequence; identical to SEQ ID NO: 94168
  derived and/or modified sequence opt2 from hemagglutinin__InfluenzaA__AGR50096

SEQ ID NO: 101892 - RNA, 1701 nt, Artificial Sequence; identical to SEQ ID NO: 94168
  derived and/or modified sequence opt2 from hemagglutinin__InfluenzaA__AGR50107

SEQ ID NO: 101893 - RNA, 1701 nt, Artificial Sequence; identical to SEQ ID NO: 94361
  derived and/or modified sequence opt2 from hemagglutinin__InfluenzaA__AGR50118

SEQ ID NO: 101894 - RNA, 1701 nt, Artificial Sequence
  derived and/or modified sequence opt2 from hemagglutinin__InfluenzaA__AGR50129
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggccagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101895 - RNA, 1701 nt, Artificial Sequence; identical to SEQ ID NO: 94168
  derived and/or modified sequence opt2 from hemagglutinin__InfluenzaA__AGR50140

SEQ ID NO: 101896 - RNA, 1701 nt, Artificial Sequence; identical to SEQ ID NO: 94363
  derived and/or modified sequence opt2 from hemagglutinin__InfluenzaA__AGR50151

SEQ ID NO: 101897 - RNA, 1698 nt, Artificial Sequence; identical to SEQ ID NO: 98210
  derived and/or modified sequence opt2 from hemagglutinin__InfluenzaA__AGR50162

SEQ ID NO: 101898 - RNA, 1701 nt, Artificial Sequence; identical to SEQ ID NO: 94168
  derived and/or modified sequence opt2 from hemagglutinin__InfluenzaA__AGR50174

SEQ ID NO: 101899 - RNA, 1701 nt, Artificial Sequence; identical to SEQ ID NO: 94207
  derived and/or modified sequence opt2 from hemagglutinin__InfluenzaA__AGR50185

SEQ ID NO: 101900 - RNA, 1701 nt, Artificial Sequence; identical to SEQ ID NO: 94168
  derived and/or modified sequence opt2 from hemagglutinin__InfluenzaA__AGR50196

SEQ ID NO: 101901 - RNA, 1701 nt, Artificial Sequence
  derived and/or modified sequence opt2 from hemagglutinin__InfluenzaA__AGR50207
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaaguccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101902 - RNA, 1701 nt, Artificial Sequence; identical to SEQ ID NO: 94168
  derived and/or modified sequence opt2 from hemagglutinin__InfluenzaA__AGR50218

SEQ ID NO: 101903 - RNA, 1701 nt, Artificial Sequence; identical to SEQ ID NO: 94168
  derived and/or modified sequence opt2 from hemagglutinin__InfluenzaA__AGR50229

SEQ ID NO: 101904 - RNA, 1701 nt, Artificial Sequence; identical to SEQ ID NO: 94363
  derived and/or modified sequence opt2 from hemagglutinin__InfluenzaA__AGR50240

SEQ ID NO: 101905 - RNA, 1701 nt, Artificial Sequence; identical to SEQ ID NO: 94221
  derived and/or modified sequence opt2 from hemagglutinin__InfluenzaA__AGR50251

SEQ ID NO: 101906 - RNA, 1701 nt, Artificial Sequence
  derived and/or modified sequence opt2 from hemagglutinin__InfluenzaA__AGR50262
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagaagacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101907 - RNA, 1701 nt, Artificial Sequence; identical to SEQ ID NO: 94168
  derived and/or modified sequence opt2 from hemagglutinin__InfluenzaA__AGR50273

SEQ ID NO: 101908 - RNA, 1701 nt, Artificial Sequence
  derived and/or modified sequence opt2 from hemagglutinin__InfluenzaA__AGR50284
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacucccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101909 - RNA, 1701 nt, Artificial Sequence; identical to SEQ ID NO: 94911
  derived and/or modified sequence opt2 from hemagglutinin__InfluenzaA__AGR50295

SEQ ID NO: 101910 - RNA, 1701 nt, Artificial Sequence; identical to SEQ ID NO: 94168
  derived and/or modified sequence opt2 from hemagglutinin__InfluenzaA__AGR50306

SEQ ID NO: 101911 - RNA, 1701 nt, Artificial Sequence; identical to SEQ ID NO: 94168
  derived and/or modified sequence opt2 from hemagglutinin__InfluenzaA__AGR50317

SEQ ID NO: 101912 - RNA, 1701 nt, Artificial Sequence; identical to SEQ ID NO: 101901
  derived and/or modified sequence opt2 from hemagglutinin__InfluenzaA__AGR50328

SEQ ID NO: 101913 - RNA, 1701 nt, Artificial Sequence
  derived and/or modified sequence opt2 from hemagglutinin__InfluenzaA__AGR50339
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagaccuccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101914 - RNA, 1701 nt, Artificial Sequence
  derived and/or modified sequence opt2 from hemagglutinin__InfluenzaA__AGR50350
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggaucaugggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101915 - RNA, 1698 nt, Artificial Sequence
  derived and/or modified sequence opt2 from hemagglutinin__InfluenzaA__AGR50361
augaagguccagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccaugggcaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 101916 - RNA, 1701 nt, Artificial Sequence
  derived and/or modified sequence opt2 from hemagglutinin__InfluenzaA__AGT18718
augaaggucauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucaucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101917 - RNA, 1701 nt, Artificial Sequence
  derived and/or modified sequence opt2 from hemagglutinin__InfluenzaA__AGT18720
augaaggucauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaaggccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccaacaccaccgccgaccagcagucccucuaccagaacgccgacgccuacgucuucgucggcaccucccgcuacuccaagaaguucaagcccgagaucgccauccgccccaagguccgcgaccaggagcgccgcaugaacuacuacuggacccucaucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101918 - RNA, 1701 nt, Artificial Sequence
  derived and/or modified sequence opt2 from hemagglutinin__InfluenzaA__AGT18721
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccauccagcgcuccgagaucugcaccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccagaacucccgcggccaccagcagucccucuaccagaacgccgacgccuacgucuucgucggcaccucccgcuacuccaagaaguucaagcccgagaucgccauccgccccaaggucaaggagcaggacggccgcauggacuacuacuggacccucaucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101919 - RNA, 1701 nt, Artificial Sequence
  derived and/or modified sequence opt2 from hemagglutinin__InfluenzaA__AGT18722
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaaguccaacaaccgcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucaucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101920 - RNA, 1701 nt, Artificial Sequence
  derived and/or modified sequence opt2 from hemagglutinin__InfluenzaA__AGT18723
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaagaccaacaaccgcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccagaacaagaaggccgagcagcagacccccuaccagaacgccgacgccuacgucuucgucggcaccucccgcuacuccaagaaguucaagcccgagaucgccauccgccccaagguccgcgaccaggagggccgcauggacuacuacuggacccucaucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101921 - RNA, 1701 nt, Artificial Sequence
  derived and/or modified sequence opt2 from hemagglutinin__InfluenzaA__AGT18724
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgucccccuccaccucggcaagugcaacaucgccggcuggauccucggcaaccccgagugcgagucccucuccaccgccuccuccugguccuacaucgucgagaccuccaagaccaacaaccgcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagacccucuaccagaacgccgacgccuacgucuucgucggcaccucccgcuacuccaagaaguucaagcccgagaucgccauccgccccaagguccgcgaccaggagggccgcaugaacuacuaccgcacccucaucgagcccgagaacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101922 - RNA, 1701 nt, Artificial Sequence
  derived and/or modified sequence opt2 from hemagglutinin__InfluenzaA__AGT18725
augaaggucauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcacccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101923 - RNA, 1701 nt, Artificial Sequence
  derived and/or modified sequence opt2 from hemagglutinin__InfluenzaA__AGT18734
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaucaacuacuacuggacccucaucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101924 - RNA, 1701 nt, Artificial Sequence; identical to SEQ ID NO: 101635
  derived and/or modified sequence opt2 from hemagglutinin__InfluenzaA__AGT18735

SEQ ID NO: 101925 - RNA, 1701 nt, Artificial Sequence
  derived and/or modified sequence opt2 from hemagglutinin__InfluenzaA__AGT18748
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacgaggagaacugcacccucaucgacgcccuccucggcgacccccagugcgacgacuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugccgccgcggcuccaacuccuccuucuucucccgccucaacuggcucacccaccucaacuucaaguaccccgcccucaacgucaccaugcccaacaacgagcaguucgacaagcucuacaucuggggcguccaccaccccuccaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101926 - RNA, 1701 nt, Artificial Sequence
  derived and/or modified sequence opt2 from hemagglutinin__InfluenzaA__AGT18749
augaagaccaucaucgcccucuccuacauccucugccucgucuucgcccagaagcuccccgagaacgacaacuccaccgccacccucugccucggccaccacgccguccccaacggcaccaucgucaagaccaucaccgacgaccagaucgaggucaccaacgccaccgagcucguccagaacuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuuccgcauccgcuccggccgcuccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101927 - RNA, 1701 nt, Artificial Sequence
  derived and/or modified sequence opt2 from hemagglutinin__InfluenzaA__AGT18751
augaagaccgucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggccgcuccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaaguccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101928 - RNA, 1701 nt, Artificial Sequence
  derived and/or modified sequence opt2 from hemagglutinin__InfluenzaA__AGT18752
augaagaccaucaucgcccucuccuacaucaucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggccgcuccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacuccuccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101929 - RNA, 1701 nt, Artificial Sequence
  derived and/or modified sequence opt2 from hemagglutinin__InfluenzaA__AGT18753
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggccgcuccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaaguccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101930 - RNA, 1701 nt, Artificial Sequence
  derived and/or modified sequence opt2 from hemagglutinin__InfluenzaA__AGT18754
augaagaccaucaucgcccucuccuacauccucugccucgucuucgcccagaagcuccccgagaacgacaacuccaccgccacccucugccucggccaccacgccguccccaacggcaccaucgucaagaccaucaccgacgaccagaucgaggucaccaacgccaccgagcucguccagaacuccuccaccggcgagaucugcgacuccccccaccagauccucgacggcgagaacugcacccucaucgacgcccuccucggcgacccccagugcgacggcuuccagaacaagaagugggaccucuucgucgagcgcggcaaggccuacuccaacugcuaccccuacgacguccccgacuacgccucccuccgcucccucgucgccaccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggccgcuccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101931 - RNA, 1701 nt, Artificial Sequence
  derived and/or modified sequence opt2 from hemagglutinin__InfluenzaA__AGT18756
augaagaccaucaucgcccucuccuacguccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacgacuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugccgccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaaguccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101932 - RNA, 1701 nt, Artificial Sequence
  derived and/or modified sequence opt2 from hemagglutinin__InfluenzaA__AGT18757
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacgacuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugccgccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101933 - RNA, 1701 nt, Artificial Sequence
  derived and/or modified sequence opt2 from hemagglutinin__InfluenzaA__AGT18758
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacgacuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugccgccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacuccuccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacaccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccucgucugcgucgcccuccucggcuucaucaugugggccugccagaagggcaacauccgcugcaacaucugcaucuga

SEQ ID NO: 101934 - RNA, 1701 nt, Artificial Sequence
  derived and/or modified sequence opt2 from hemagglutinin__InfluenzaA__AGT18759
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacgacuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugccgccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacuccuccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccucgucugcgucgcccuccucggcuucaucaugugggccugccagaagggcaacauccgcugcaacaucugcaucuga

SEQ ID NO: 101935 - RNA, 1701 nt, Artificial Sequence
  derived and/or modified sequence opt2 from hemagglutinin__InfluenzaA__AGT18760
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacgacuuccagaacaagaagugggaccucuucgucgagcgcaacaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugccgccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaaguccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccucgucugcgucgcccuccucggcuucaucaugugggccugccagaagggcaacauccgcugcaacaucugcaucuga

SEQ ID NO: 101936 - RNA, 1701 nt, Artificial Sequence
  derived and/or modified sequence opt2 from hemagglutinin__InfluenzaA__AGT18761
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacgacuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugccgccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacuccuccgaguuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccucgucugcgucgcccuccucggcuucaucaugugggccugccagaagggcaacauccgcugcaacaucugcaucuga

SEQ ID NO: 101937 - RNA, 1701 nt, Artificial Sequence
  derived and/or modified sequence opt2 from hemagglutinin__InfluenzaA__AGT37102
auggaggccaagcucgucguccucuucugcgccuucaccacccucaaggccgacaucaucugcgucggcuaccacgccaacaacuccaccgacaccgucgacaccaucauggagaagaacgucaccgucacccacuccgucaaccuccucgagaacucccacaacggcaagcucugcucccucaacggcaaggccccccuccagcucggcaacugcaacgucgccggcuggauccucggcaaccccgagugcgaccuccuccucaccgccaacuccugguccuacaucaucgagaccuccuccuccaagaacggcaccugcuaccccggcgaguucuccgacuacgaggagcuccgcgagcuccucuccaccgucuccuccuucgagcgcuucgagaucuuccccaaggccaccuccuggcccaaccacgagaccaccaagggcgccaccaucgccugcucccacuccggcgccuccuccuucuaccgcaaccuccucuggaucgucaagaagggcaacuccuaccccaagaucuccaaguccuacaccaacaaccgcggcaaggagguccucgucaucuggggcguccaccacccccccaccgacuccucccagcaggcccucuaccagaacacccacaccuacaucuccgucggcuccuccaaguacuaccagcgcuucacccccgucgucgccgcccgccccaagauccgcgagcaggagggccgcaugaacuacuacuggacccuccucgagcagggcgacaccaucaccuucgaggccaccggcaaccucaucgcccccugguacgccuucgcccucgacaugggcuccuccuccggcaucauggucuccgacgcccccguccacaacugcaccaccaagugccagaccccccacggcgcccucaaguccaaccuccccuuccagaacguccaccccaucaccaucggcgagugccccaaguacgucaaguccacccagcuccgcauggccaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaucgccaucgacggcaucuccaacaaggucaacuccaucaucgagaagaugaacguccaguucaccuccgucggcaaggaguucaacgaccucgagaagcgcaucgagaaccucaacaagaaggucgacgacggcuuccucgacgucuggaccuacaacgccgagcuccucguccuccucgagaacgagcgcacccucgacuuccacgacuucaacgucaagaaccucuacgagaaggucaagucccagcuccgcaacaacgccaaggagaucggcaacggcugcuucgaguucuaccacaagugcgacaacgagugcauggagaacgucaagaacggcaccuacaacuaccccaaguacuccgaggaguccaagcucaaccgcgagaagaucgacggcgucaagcucgaguccaucggcguccaccagauccucgccaucuacuccaccgucgccuccucccucguccuccucgucucccucggcgccaucuccuucuggaugugcuccaacggcucccuccagugccgcaucugcaucuga

SEQ ID NO: 101938 - RNA, 1701 nt, Artificial Sequence
  derived and/or modified sequence opt2 from hemagglutinin__InfluenzaA__AGU01877
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccaccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucaucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101939 - RNA, 1701 nt, Artificial Sequence
  derived and/or modified sequence opt2 from hemagglutinin__InfluenzaA__AGU01878
augaaggccauccucgucgucaugcucuacacccucgccaccgccaacgccgacacccucugcaucggcuaccacgccaacaacuccaccgacaccgucgacaccguccucgagaagaacgucaccgucacccacuccgucaaccuccucgaggacaagcacgacggcaagcucugcaagcuccgcggcgucgccccccuccaccucggcaagugcaacaucgccggcuggauccucggcaaccccgagugcgagucccucuccaccgccuccuccugguccuacaucgucgagaccuccggcuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaucuccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 101940 - RNA, 1701 nt, Artificial Sequence
  derived and/or modified sequence opt2 from hemagglutinin__InfluenzaA__AGU01879
augaaggccauccucgucgucaugcucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacgagaagcucugcaagcuccgcggcgucgccccccuccaccucggcaagugcaacaucgccggcuggauccucggcaaccccgagugcgagucccucuccaccgccuccuccugguccuacaucgucgagaccuccggcuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccaggccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101941 - RNA, 1701 nt, Artificial Sequence
  derived and/or modified sequence opt2 from hemagglutinin__InfluenzaA__AGU01881
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucaccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagauguuccccaagaccuccuccuggcccaaccacgacuccaacaagggcgucaccgccgccugcccccaggccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucaucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101942 - RNA, 1701 nt, Artificial Sequence
  derived and/or modified sequence opt2 from hemagglutinin__InfluenzaA__AGU01883
augaaggccauccucgucgucaugcucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccggcuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaucuccuacaucaacaacaaggagaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 101943 - RNA, 1701 nt, Artificial Sequence; identical to SEQ ID NO: 101572
  derived and/or modified sequence opt2 from hemagglutinin__InfluenzaA__AGU01884

SEQ ID NO: 101944 - RNA, 1701 nt, Artificial Sequence
  derived and/or modified sequence opt2 from hemagglutinin__InfluenzaA__AGU01885
augaaggccauccucgucgucaugcucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacgagaagcucugcaagcuccgcggcgucgccccccuccaccucggcaagugcaacaucgccggcuggauccucggcaaccccgagugcgagucccucuccaccgccuccuccugguccuacaucgucgagaccuccggcuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccaggccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacguccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101945 - RNA, 1701 nt, Artificial Sequence
  derived and/or modified sequence opt2 from hemagglutinin__InfluenzaA__AGU01887
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucaucgagcccggcgacaagaucaccuucgaggccaccggcaaccucgucgucccccgcuacgccuucgccgucgagcgcaacgccggcuccggcaucaucaucuccgacacccccguccacaacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101946 - RNA, 1701 nt, Artificial Sequence
  derived and/or modified sequence opt2 from hemagglutinin__InfluenzaA__AGU01888
augaaggccauccucgucgucaugcucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccggcuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccaggccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccgcuucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101947 - RNA, 1701 nt, Artificial Sequence; identical to SEQ ID NO: 101938
  derived and/or modified sequence opt2 from hemagglutinin__InfluenzaA__AGU01889

SEQ ID NO: 101948 - RNA, 1701 nt, Artificial Sequence
  derived and/or modified sequence opt2 from hemagglutinin__InfluenzaA__AGU01890
augaaggccauccucgucgucaugcucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccggcuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccaggccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101949 - RNA, 1701 nt, Artificial Sequence
  derived and/or modified sequence opt2 from hemagglutinin__InfluenzaA__AGU92645
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagacccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgagacccgccccaagguccgcgaccaggagggccgcaugaacuacuacuggacccucgucgagcccggcgacaagaucaccuucgaggccaccggcaaccucgucgucccccgcuacgccuucgccauggagcgcgacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 101950 - RNA, 1701 nt, Artificial Sequence
  derived and/or modified sequence opt2 from hemagglutinin__InfluenzaA__AGU92667
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagacccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccacccgccccaagguccgcgaccaggagggccgcaugaacuacuacuggacccucgucgagcccggcgacaagaucaccuucgaggccaccggcaaccucgucgucccccgcuacgccuucgccauggagcgcgacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcgcccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 101951 - RNA, 1701 nt, Artificial Sequence
  derived and/or modified sequence opt2 from hemagglutinin__InfluenzaA__AGU92678
augaaggccauccucgucguccuccucuacaccuucgccaccgccaacgccgacacccucugcaucggccaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagacccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccacccgccccaagguccgcgaccaggagggccgcaugaacuacuacuggacccucgucgagcccggcgacaagaucaccuucgaggccaccggcaaccucgucgucccccgcuacgccuucgccauggagcgcgacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 101952 - RNA, 1701 nt, Artificial Sequence
  derived and/or modified sequence opt2 from hemagglutinin__InfluenzaA__AGU92711
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagcagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101953 - RNA, 1701 nt, Artificial Sequence
  derived and/or modified sequence opt2 from hemagglutinin__InfluenzaA__AGU92722
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccgacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101954 - RNA, 1701 nt, Artificial Sequence; identical to SEQ ID NO: 101953
  derived and/or modified sequence opt2 from hemagglutinin__InfluenzaA__AGU92733

SEQ ID NO: 101955 - RNA, 1701 nt, Artificial Sequence
  derived and/or modified sequence opt2 from hemagglutinin__InfluenzaA__AGU92744
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccgacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcgccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101956 - RNA, 1701 nt, Artificial Sequence
  derived and/or modified sequence opt2 from hemagglutinin__InfluenzaA__AGU92755
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaaggaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101957 - RNA, 1701 nt, Artificial Sequence
  derived and/or modified sequence opt2 from hemagglutinin__InfluenzaA__AGU92766
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagacccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaguccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccacccgccccaagguccgcgaccaggagggccgcaugaacuacuacuggacccucgucgagcccggcgacaagaucaccuucgaggccaccggcaaccucgucgucccccgcuacgccuucgccauggagcgcgacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 101958 - RNA, 1701 nt, Artificial Sequence
  derived and/or modified sequence opt2 from hemagglutinin__InfluenzaA__AGU92777
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagacccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaguccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcaguccaucuaccagaacgccgacaccuacgucuucgucggcaccucccgcuacuccaagaaguucaagcccgagaucgccacccgccccaagguccgcgaccaggagggccgcaugaacuacuacuggacccucgucgagcccggcgacaagaucaccuucgaggccaccggcaaccucgucgucccccgcuacgccuucgccauggagcgcgacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 101959 - RNA, 1701 nt, Artificial Sequence
  derived and/or modified sequence opt2 from hemagglutinin__InfluenzaA__AGU92788
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagacccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccgacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccacccgccccaagguccgcgaccgcgagggccgcaugaacuacuacuggacccucgucgagcccggcgacaagaucaccuucgaggccaccggcaaccucgucgucccccgcuacgccuucgccauggagcgcgacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcaugcucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 101960 - RNA, 1701 nt, Artificial Sequence
  derived and/or modified sequence opt2 from hemagglutinin__InfluenzaA__AGU92799
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagacccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccgaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccacccgccccaagguccgcgaccgcgagggccgcaugaacuacuacuggacccucgucgagcccggcgacaagaucaccuucgaggccaccggcaaccucgucgucccccgcuacgccuucgccauggagcgcgacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 101961 - RNA, 1701 nt, Artificial Sequence
  derived and/or modified sequence opt2 from hemagglutinin__InfluenzaA__AGU92821
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagacccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagauguucaagcccgagaucgccacccgccccaagguccgcgaccgcgagggccgcaugaacuacuacuggacccucgucgagcccggcgacaagaucaccuucgaggccaccggcaaccucgucgucccccgcuacgccuucgccauggagcgcgacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 101962 - RNA, 1701 nt, Artificial Sequence
  derived and/or modified sequence opt2 from hemagglutinin__InfluenzaA__AGU92843
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcgacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccgcgagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101963 - RNA, 1710 nt, Artificial Sequence
  derived and/or modified sequence opt2 from hemagglutinin__InfluenzaA__AGU92854
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccgacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccgcgagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccucaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101964 - RNA, 1701 nt, Artificial Sequence
  derived and/or modified sequence opt2 from hemagglutinin__InfluenzaA__AGU92887
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgacgaccagcagucccucuaccagaacgccgacgccuacgucuucgucggcuccucccgcuacuccaagaaguucaagcccgagaucgccauccgccccaagguccgcgaccgcgagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101965 - RNA, 1701 nt, Artificial Sequence; identical to SEQ ID NO: 101949
  derived and/or modified sequence opt2 from hemagglutinin__InfluenzaA__AGU92898

SEQ ID NO: 101966 - RNA, 1701 nt, Artificial Sequence; identical to SEQ ID NO: 101950
  derived and/or modified sequence opt2 from hemagglutinin__InfluenzaA__AGU92909

SEQ ID NO: 101967 - RNA, 1701 nt, Artificial Sequence; identical to SEQ ID NO: 101952
  derived and/or modified sequence opt2 from hemagglutinin__InfluenzaA__AGU92931

SEQ ID NO: 101968 - RNA, 1701 nt, Artificial Sequence; identical to SEQ ID NO: 101953
  derived and/or modified sequence opt2 from hemagglutinin__InfluenzaA__AGU92942

SEQ ID NO: 101969 - RNA, 1701 nt, Artificial Sequence; identical to SEQ ID NO: 101953
  derived and/or modified sequence opt2 from hemagglutinin__InfluenzaA__AGU92953

SEQ ID NO: 101970 - RNA, 1701 nt, Artificial Sequence
  derived and/or modified sequence opt2 from hemagglutinin__InfluenzaA__AGU92964
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagacccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccacccgccccaagguccgcgaccgcgagggccgcaugaacuacuacuggacccucgucgagcccggcgacaagaucaccuucgaggccaccggcaaccucgucgucccccgcuacgccuucgccauggagcgcgacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcaugcucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 101971 - RNA, 1701 nt, Artificial Sequence
  derived and/or modified sequence opt2 from hemagglutinin__InfluenzaA__AGU92975
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagacccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaaggagaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccacccgccccaagguccgcgaccgcgagggccgcaugaacuacuacuggacccucgucgagcccggcgacaagaucaccuucgaggccaccggcaaccucgucgucccccgcuacgccuucgccauggagcgcgacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 101972 - RNA, 1701 nt, Artificial Sequence; identical to SEQ ID NO: 101962
  derived and/or modified sequence opt2 from hemagglutinin__InfluenzaA__AGU92986

SEQ ID NO: 101973 - RNA, 1701 nt, Artificial Sequence
  derived and/or modified sequence opt2 from hemagglutinin__InfluenzaA__AGU92997
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagauguucaagcccgagaucgccauccgccccaagguccgcgaccgcgagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 101974 - RNA, 1701 nt, Artificial Sequence; identical to SEQ ID NO: 101964
  derived and/or modified sequence opt2 from hemagglutinin__InfluenzaA__AGU93008

SEQ ID NO: 101975 - RNA, 1698 nt, Artificial Sequence; identical to SEQ ID NO: 98066
  derived and/or modified sequence opt2 from hemagglutinin__InfluenzaA__AGU93019

SEQ ID NO: 101976 - RNA, 1701 nt, Artificial Sequence; identical to SEQ ID NO: 98562
  derived and/or modified sequence opt2 from hemagglutinin__InfluenzaA__AGU93031

SEQ ID NO: 101977 - RNA, 1701 nt, Artificial Sequence
  derived and/or modified sequence opt2 from hemagglutinin__InfluenzaA__AGU93042
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagacccucuccaccgccaacuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcgacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacauccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 101978 - RNA, 1701 nt, Artificial Sequence
  derived and/or modified sequence opt2 from hemagglutinin__InfluenzaA__AGU93053
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagacccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccacccgccccaagguccgcgaccaggagggccgcaugaacuacuacuggacccucgucgagcccggcgacaagaucaccuucgaggccaccggcaaccucgucgucccccgcuacgccuucgccauggagcgcgacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 101979 - RNA, 1701 nt, Artificial Sequence
  derived and/or modified sequence opt2 from hemagglutinin__InfluenzaA__AGV99014
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101980 - RNA, 1701 nt, Artificial Sequence; identical to SEQ ID NO: 101506
  derived and/or modified sequence opt2 from hemagglutinin__InfluenzaA__AGV99037

SEQ ID NO: 101981 - RNA, 1701 nt, Artificial Sequence
  derived and/or modified sequence opt2 from hemagglutinin__InfluenzaA__AGV99049
augaagaccaucaucgcccucuccuacauccucugccucgucuucgcccagaagcuccccggcaacgacaacuccaccgccacccucugccucggccaccacgccguccccaacggcaccgucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacggcaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 101982 - RNA, 1701 nt, Artificial Sequence
  derived and/or modified sequence opt2 from hemagglutinin__InfluenzaA__AGV99073
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaagcccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101983 - RNA, 1701 nt, Artificial Sequence; identical to SEQ ID NO: 101370
  derived and/or modified sequence opt2 from hemagglutinin__InfluenzaA__AGV99085

SEQ ID NO: 101984 - RNA, 1701 nt, Artificial Sequence
  derived and/or modified sequence opt2 from hemagglutinin__InfluenzaA__AGV99097
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagauccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101985 - RNA, 1701 nt, Artificial Sequence
  derived and/or modified sequence opt2 from hemagglutinin__InfluenzaA__AGV99121
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacgacuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101986 - RNA, 1701 nt, Artificial Sequence; identical to SEQ ID NO: 101985
  derived and/or modified sequence opt2 from hemagglutinin__InfluenzaA__AGV99133

SEQ ID NO: 101987 - RNA, 1701 nt, Artificial Sequence; identical to SEQ ID NO: 101979
  derived and/or modified sequence opt2 from hemagglutinin__InfluenzaA__AGV99145

SEQ ID NO: 101988 - RNA, 1701 nt, Artificial Sequence
  derived and/or modified sequence opt2 from hemagglutinin__InfluenzaA__AGV99157
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucaucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacacccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101989 - RNA, 1701 nt, Artificial Sequence; identical to SEQ ID NO: 101506
  derived and/or modified sequence opt2 from hemagglutinin__InfluenzaA__AGV99169

SEQ ID NO: 101990 - RNA, 1701 nt, Artificial Sequence; identical to SEQ ID NO: 101979
  derived and/or modified sequence opt2 from hemagglutinin__InfluenzaA__AGV99181

SEQ ID NO: 101991 - RNA, 1701 nt, Artificial Sequence
  derived and/or modified sequence opt2 from hemagglutinin__InfluenzaA__AGV99193
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacacccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101992 - RNA, 1701 nt, Artificial Sequence; identical to SEQ ID NO: 101380
  derived and/or modified sequence opt2 from hemagglutinin__InfluenzaA__AGV99956

SEQ ID NO: 101993 - RNA, 1701 nt, Artificial Sequence
  derived and/or modified sequence opt2 from hemagglutinin__InfluenzaA__AGV99986
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcauccgccgcuccaacaacuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101994 - RNA, 1701 nt, Artificial Sequence
  derived and/or modified sequence opt2 from hemagglutinin__InfluenzaA__AGW00065
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacaccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101995 - RNA, 1701 nt, Artificial Sequence; identical to SEQ ID NO: 101506
  derived and/or modified sequence opt2 from hemagglutinin__InfluenzaA__AGW00077

SEQ ID NO: 101996 - RNA, 1701 nt, Artificial Sequence; identical to SEQ ID NO: 101370
  derived and/or modified sequence opt2 from hemagglutinin__InfluenzaA__AGW00089

SEQ ID NO: 101997 - RNA, 1701 nt, Artificial Sequence; identical to SEQ ID NO: 101506
  derived and/or modified sequence opt2 from hemagglutinin__InfluenzaA__AGW00101

SEQ ID NO: 101998 - RNA, 1701 nt, Artificial Sequence
  derived and/or modified sequence opt2 from hemagglutinin__InfluenzaA__AGW00113
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaccuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 101999 - RNA, 1701 nt, Artificial Sequence; identical to SEQ ID NO: 101506
  derived and/or modified sequence opt2 from hemagglutinin__InfluenzaA__AGW00125

SEQ ID NO: 102000 - RNA, 1701 nt, Artificial Sequence; identical to SEQ ID NO: 101506
  derived and/or modified sequence opt2 from hemagglutinin__InfluenzaA__AGW00137

SEQ ID NO: 102001 - RNA, 1701 nt, Artificial Sequence; identical to SEQ ID NO: 101506
  derived and/or modified sequence opt2 from hemagglutinin__InfluenzaA__AGW00149

SEQ ID NO: 102002 - RNA, 1701 nt, Artificial Sequence; identical to SEQ ID NO: 101506
  derived and/or modified sequence opt2 from hemagglutinin__InfluenzaA__AGW00161

SEQ ID NO: 102003 - RNA, 1701 nt, Artificial Sequence; identical to SEQ ID NO: 101506
  derived and/or modified sequence opt2 from hemagglutinin__InfluenzaA__AGW00173

SEQ ID NO: 102004 - RNA, 1701 nt, Artificial Sequence
  derived and/or modified sequence opt2 from hemagglutinin__InfluenzaA__AGW00185
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucaucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102005 - RNA, 1701 nt, Artificial Sequence; identical to SEQ ID NO: 101506
  derived and/or modified sequence opt2 from hemagglutinin__InfluenzaA__AGW00709

SEQ ID NO: 102006 - RNA, 1701 nt, Artificial Sequence; identical to SEQ ID NO: 101506
  derived and/or modified sequence opt2 from hemagglutinin__InfluenzaA__AGW00721

SEQ ID NO: 102007 - RNA, 1701 nt, Artificial Sequence; identical to SEQ ID NO: 101506
  derived and/or modified sequence opt2 from hemagglutinin__InfluenzaA__AGW00733

SEQ ID NO: 102008 - RNA, 1701 nt, Artificial Sequence; identical to SEQ ID NO: 101506
  derived and/or modified sequence opt2 from hemagglutinin__InfluenzaA__AGW00745

SEQ ID NO: 102009 - RNA, 1701 nt, Artificial Sequence
  derived and/or modified sequence opt2 from hemagglutinin__InfluenzaA__AGW00757
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaaccucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102010 - RNA, 1701 nt, Artificial Sequence; identical to SEQ ID NO: 101509
  derived and/or modified sequence opt2 from hemagglutinin__InfluenzaA__AGW00769

SEQ ID NO: 102011 - RNA, 1701 nt, Artificial Sequence; identical to SEQ ID NO: 101395
  derived and/or modified sequence opt2 from hemagglutinin__InfluenzaA__AGW00781

SEQ ID NO: 102012 - RNA, 1701 nt, Artificial Sequence; identical to SEQ ID NO: 101994
  derived and/or modified sequence opt2 from hemagglutinin__InfluenzaA__AGW00793

SEQ ID NO: 102013 - RNA, 1701 nt, Artificial Sequence; identical to SEQ ID NO: 101506
  derived and/or modified sequence opt2 from hemagglutinin__InfluenzaA__AGW00805

SEQ ID NO: 102014 - RNA, 1701 nt, Artificial Sequence; identical to SEQ ID NO: 101347
  derived and/or modified sequence opt2 from hemagglutinin__InfluenzaA__AGW00817

SEQ ID NO: 102015 - RNA, 1701 nt, Artificial Sequence; identical to SEQ ID NO: 101993
  derived and/or modified sequence opt2 from hemagglutinin__InfluenzaA__AGW00829

SEQ ID NO: 102016 - RNA, 1701 nt, Artificial Sequence
  derived and/or modified sequence opt2 from hemagglutinin__InfluenzaA__AGW00841
augaagaccaucaucgcccucuccuacauccucugccucgucuucgcccagaagcuccccggcaacgacaacuccaccgccacccucugccucggccaccacgccguccccaacggcaccaucgucaagaccaucaccaacggccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102017 - RNA, 1701 nt, Artificial Sequence
  derived and/or modified sequence opt2 from hemagglutinin__InfluenzaA__AGW00853
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccagcccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102018 - RNA, 1701 nt, Artificial Sequence; identical to SEQ ID NO: 101370
  derived and/or modified sequence opt2 from hemagglutinin__InfluenzaA__AGW00865

SEQ ID NO: 102019 - RNA, 1701 nt, Artificial Sequence
  derived and/or modified sequence opt2 from hemagglutinin__InfluenzaA__AGW00877
augaagaccaucaucgcccucuccuacauccucugccucgucuucgcccaggagcuccccggcaacgacgacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcuuccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102020 - RNA, 1701 nt, Artificial Sequence
  derived and/or modified sequence opt2 from hemagglutinin__InfluenzaA__AGW00889
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggguccucuggaucuccuucgccaucuccugcuuccuccucugcgucgcccuccucggcuucaucaugugggccugccagaagggcaacauccgcugcaacaucugcaucuga

SEQ ID NO: 102021 - RNA, 1701 nt, Artificial Sequence; identical to SEQ ID NO: 101370
  derived and/or modified sequence opt2 from hemagglutinin__InfluenzaA__AGW00901

SEQ ID NO: 102022 - RNA, 1701 nt, Artificial Sequence; identical to SEQ ID NO: 101370
  derived and/or modified sequence opt2 from hemagglutinin__InfluenzaA__AGW00913

SEQ ID NO: 102023 - RNA, 1701 nt, Artificial Sequence; identical to SEQ ID NO: 101506
  derived and/or modified sequence opt2 from hemagglutinin__InfluenzaA__AGW00931

SEQ ID NO: 102024 - RNA, 1701 nt, Artificial Sequence; identical to SEQ ID NO: 101506
  derived and/or modified sequence opt2 from hemagglutinin__InfluenzaA__AGW01244

SEQ ID NO: 102025 - RNA, 1701 nt, Artificial Sequence; identical to SEQ ID NO: 101380
  derived and/or modified sequence opt2 from hemagglutinin__InfluenzaA__AGW01256

SEQ ID NO: 102026 - RNA, 1701 nt, Artificial Sequence
  derived and/or modified sequence opt2 from hemagglutinin__InfluenzaA__AGW01295
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagauccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102027 - RNA, 1701 nt, Artificial Sequence; identical to SEQ ID NO: 101370
  derived and/or modified sequence opt2 from hemagglutinin__InfluenzaA__AGW01307

SEQ ID NO: 102028 - RNA, 1701 nt, Artificial Sequence
  derived and/or modified sequence opt2 from hemagglutinin__InfluenzaA__AGW01319
augaagaccaucaucgcccucuccuacauccucugccucgucuucgcccaggagcuccccggcaacgacgacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccaggacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaacaagcucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102029 - RNA, 1701 nt, Artificial Sequence
  derived and/or modified sequence opt2 from hemagglutinin__InfluenzaA__AGW01331
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgagcacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102030 - RNA, 1701 nt, Artificial Sequence; identical to SEQ ID NO: 101506
  derived and/or modified sequence opt2 from hemagglutinin__InfluenzaA__AGW01343

SEQ ID NO: 102031 - RNA, 1701 nt, Artificial Sequence; identical to SEQ ID NO: 101509
  derived and/or modified sequence opt2 from hemagglutinin__InfluenzaA__AGW01355

SEQ ID NO: 102032 - RNA, 1701 nt, Artificial Sequence; identical to SEQ ID NO: 101380
  derived and/or modified sequence opt2 from hemagglutinin__InfluenzaA__AGW01367

SEQ ID NO: 102033 - RNA, 1701 nt, Artificial Sequence; identical to SEQ ID NO: 101506
  derived and/or modified sequence opt2 from hemagglutinin__InfluenzaA__AGW01391

SEQ ID NO: 102034 - RNA, 1701 nt, Artificial Sequence
  derived and/or modified sequence opt2 from hemagglutinin__InfluenzaA__AGW01403
augaagaccaucaucgcccucuccuacauccucugccucaucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccgccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacuacgucuaccgcgacgaggcccucaacaaccgcuuccagaucaagggcgucgagcucaaguccggcuacaaggacuggauccucuggaucuccuucgccaccuccugcuuccuccucugcgucgcccuccucggcuucaucaugugggccugccagaagggcaacauccgcugcaacaucugcaucuga

SEQ ID NO: 102035 - RNA, 1701 nt, Artificial Sequence; identical to SEQ ID NO: 101370
  derived and/or modified sequence opt2 from hemagglutinin__InfluenzaA__AGW01415

SEQ ID NO: 102036 - RNA, 1701 nt, Artificial Sequence; identical to SEQ ID NO: 101370
  derived and/or modified sequence opt2 from hemagglutinin__InfluenzaA__AGW01427

SEQ ID NO: 102037 - RNA, 1701 nt, Artificial Sequence; identical to SEQ ID NO: 101370
  derived and/or modified sequence opt2 from hemagglutinin__InfluenzaA__AGW01439

SEQ ID NO: 102038 - RNA, 1701 nt, Artificial Sequence
  derived and/or modified sequence opt2 from hemagglutinin__InfluenzaA__AGW01451
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgucgacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102039 - RNA, 1701 nt, Artificial Sequence; identical to SEQ ID NO: 101506
  derived and/or modified sequence opt2 from hemagglutinin__InfluenzaA__AGW01463

SEQ ID NO: 102040 - RNA, 1701 nt, Artificial Sequence; identical to SEQ ID NO: 101506
  derived and/or modified sequence opt2 from hemagglutinin__InfluenzaA__AGW01475

SEQ ID NO: 102041 - RNA, 1701 nt, Artificial Sequence
  derived and/or modified sequence opt2 from hemagglutinin__InfluenzaA__AGW01487
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccacuccaacuucaaguaccccgcccucaacgucaccaugcccaacaacgagcaguucgacaagcucuacaucuggggcguccaccaccccggcaccggcaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102042 - RNA, 1701 nt, Artificial Sequence; identical to SEQ ID NO: 101370
  derived and/or modified sequence opt2 from hemagglutinin__InfluenzaA__AGW01499

SEQ ID NO: 102043 - RNA, 1701 nt, Artificial Sequence
  derived and/or modified sequence opt2 from hemagglutinin__InfluenzaA__AGW01511
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgccgcccuccucggcuucaucaugugggccugccagaagggcaacauccgcugcaacaucugcaucuga

SEQ ID NO: 102044 - RNA, 1701 nt, Artificial Sequence
  derived and/or modified sequence opt2 from hemagglutinin__InfluenzaA__AGW01535
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaaggaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102045 - RNA, 1701 nt, Artificial Sequence; identical to SEQ ID NO: 101370
  derived and/or modified sequence opt2 from hemagglutinin__InfluenzaA__AGW01547

SEQ ID NO: 102046 - RNA, 1701 nt, Artificial Sequence; identical to SEQ ID NO: 101506
  derived and/or modified sequence opt2 from hemagglutinin__InfluenzaA__AGW01559

SEQ ID NO: 102047 - RNA, 1701 nt, Artificial Sequence; identical to SEQ ID NO: 101506
  derived and/or modified sequence opt2 from hemagglutinin__InfluenzaA__AGW01571

SEQ ID NO: 102048 - RNA, 1701 nt, Artificial Sequence; identical to SEQ ID NO: 101506
  derived and/or modified sequence opt2 from hemagglutinin__InfluenzaA__AGW01583

SEQ ID NO: 102049 - RNA, 1701 nt, Artificial Sequence; identical to SEQ ID NO: 101506
  derived and/or modified sequence opt2 from hemagglutinin__InfluenzaA__AGW01595

SEQ ID NO: 102050 - RNA, 1701 nt, Artificial Sequence
  derived and/or modified sequence opt2 from hemagglutinin__InfluenzaA__AGW01607
augaagaccaucaucgcccucuccuacauccucugccucguccucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102051 - RNA, 1701 nt, Artificial Sequence; identical to SEQ ID NO: 101509
  derived and/or modified sequence opt2 from hemagglutinin__InfluenzaA__AGW01619

SEQ ID NO: 102052 - RNA, 1701 nt, Artificial Sequence; identical to SEQ ID NO: 101506
  derived and/or modified sequence opt2 from hemagglutinin__InfluenzaA__AGW01631

SEQ ID NO: 102053 - RNA, 1701 nt, Artificial Sequence
  derived and/or modified sequence opt2 from hemagglutinin__InfluenzaA__AGW01643
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102054 - RNA, 1701 nt, Artificial Sequence; identical to SEQ ID NO: 101506
  derived and/or modified sequence opt2 from hemagglutinin__InfluenzaA__AGW01655

SEQ ID NO: 102055 - RNA, 1701 nt, Artificial Sequence
  derived and/or modified sequence opt2 from hemagglutinin__InfluenzaA__AGW01667
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacgagaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102056 - RNA, 1701 nt, Artificial Sequence; identical to SEQ ID NO: 101506
  derived and/or modified sequence opt2 from hemagglutinin__InfluenzaA__AGW01679

SEQ ID NO: 102057 - RNA, 1701 nt, Artificial Sequence
  derived and/or modified sequence opt2 from hemagglutinin__InfluenzaA__AGW01691
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucgucaugugggccugccagaagggcaacauccgcugcaacaucugcaucuga

SEQ ID NO: 102058 - RNA, 1701 nt, Artificial Sequence; identical to SEQ ID NO: 101370
  derived and/or modified sequence opt2 from hemagglutinin__InfluenzaA__AGW01701

SEQ ID NO: 102059 - RNA, 1701 nt, Artificial Sequence; identical to SEQ ID NO: 101370
  derived and/or modified sequence opt2 from hemagglutinin__InfluenzaA__AGW01713

SEQ ID NO: 102060 - RNA, 1701 nt, Artificial Sequence
  derived and/or modified sequence opt2 from hemagglutinin__InfluenzaA__AGW01725
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccucaucugcgucgcccuccucggcuucaucaugugggccugccagaagggcaacauccgcugcaacaucugcaucuga

SEQ ID NO: 102061 - RNA, 1701 nt, Artificial Sequence; identical to SEQ ID NO: 101370
  derived and/or modified sequence opt2 from hemagglutinin__InfluenzaA__AGW01737

SEQ ID NO: 102062 - RNA, 1701 nt, Artificial Sequence; identical to SEQ ID NO: 101506
  derived and/or modified sequence opt2 from hemagglutinin__InfluenzaA__AGW01749

SEQ ID NO: 102063 - RNA, 1701 nt, Artificial Sequence; identical to SEQ ID NO: 101506
  derived and/or modified sequence opt2 from hemagglutinin__InfluenzaA__AGW01761

SEQ ID NO: 102064 - RNA, 1701 nt, Artificial Sequence; identical to SEQ ID NO: 101370
  derived and/or modified sequence opt2 from hemagglutinin__InfluenzaA__AGW01773

SEQ ID NO: 102065 - RNA, 1701 nt, Artificial Sequence; identical to SEQ ID NO: 101506
  derived and/or modified sequence opt2 from hemagglutinin__InfluenzaA__AGW01785

SEQ ID NO: 102066 - RNA, 1701 nt, Artificial Sequence; identical to SEQ ID NO: 101370
  derived and/or modified sequence opt2 from hemagglutinin__InfluenzaA__AGW01797

SEQ ID NO: 102067 - RNA, 1701 nt, Artificial Sequence; identical to SEQ ID NO: 101506
  derived and/or modified sequence opt2 from hemagglutinin__InfluenzaA__AGW01809

SEQ ID NO: 102068 - RNA, 1701 nt, Artificial Sequence; identical to SEQ ID NO: 101506
  derived and/or modified sequence opt2 from hemagglutinin__InfluenzaA__AGW01821

SEQ ID NO: 102069 - RNA, 1701 nt, Artificial Sequence; identical to SEQ ID NO: 101505
  derived and/or modified sequence opt2 from hemagglutinin__InfluenzaA__AGW01833

SEQ ID NO: 102070 - RNA, 1701 nt, Artificial Sequence
  derived and/or modified sequence opt2 from hemagglutinin__InfluenzaA__AGW01845
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaccaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102071 - RNA, 1701 nt, Artificial Sequence; identical to SEQ ID NO: 101506
  derived and/or modified sequence opt2 from hemagglutinin__InfluenzaA__AGW01857

SEQ ID NO: 102072 - RNA, 1701 nt, Artificial Sequence; identical to SEQ ID NO: 101506
  derived and/or modified sequence opt2 from hemagglutinin__InfluenzaA__AGW01869

SEQ ID NO: 102073 - RNA, 1701 nt, Artificial Sequence; identical to SEQ ID NO: 102057
  derived and/or modified sequence opt2 from hemagglutinin__InfluenzaA__AGW01881

SEQ ID NO: 102074 - RNA, 1701 nt, Artificial Sequence; identical to SEQ ID NO: 101380
  derived and/or modified sequence opt2 from hemagglutinin__InfluenzaA__AGW01893

SEQ ID NO: 102075 - RNA, 1701 nt, Artificial Sequence; identical to SEQ ID NO: 101395
  derived and/or modified sequence opt2 from hemagglutinin__InfluenzaA__AGW01905

SEQ ID NO: 102076 - RNA, 1701 nt, Artificial Sequence; identical to SEQ ID NO: 101506
  derived and/or modified sequence opt2 from hemagglutinin__InfluenzaA__AGW01917

SEQ ID NO: 102077 - RNA, 1701 nt, Artificial Sequence; identical to SEQ ID NO: 101370
  derived and/or modified sequence opt2 from hemagglutinin__InfluenzaA__AGW01929

SEQ ID NO: 102078 - RNA, 1701 nt, Artificial Sequence; identical to SEQ ID NO: 101506
  derived and/or modified sequence opt2 from hemagglutinin__InfluenzaA__AGW01941

SEQ ID NO: 102079 - RNA, 1701 nt, Artificial Sequence; identical to SEQ ID NO: 101370
  derived and/or modified sequence opt2 from hemagglutinin__InfluenzaA__AGW01953

SEQ ID NO: 102080 - RNA, 1701 nt, Artificial Sequence
  derived and/or modified sequence opt2 from hemagglutinin__InfluenzaA__AGW01965
augaagaccaucaucgcccucuccuacauccucugccucgucuucgcccaggagcuccccggcaacgacgacuccauggccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgacugcaucggcuccauccgcaacggcaccuacgaccacaacgucuaccgcgacgaggcccucaacaaccgcuuccagaucaagggcaucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102081 - RNA, 1701 nt, Artificial Sequence; identical to SEQ ID NO: 101506
  derived and/or modified sequence opt2 from hemagglutinin__InfluenzaA__AGW01977

SEQ ID NO: 102082 - RNA, 1701 nt, Artificial Sequence; identical to SEQ ID NO: 101506
  derived and/or modified sequence opt2 from hemagglutinin__InfluenzaA__AGW01989

SEQ ID NO: 102083 - RNA, 1701 nt, Artificial Sequence; identical to SEQ ID NO: 101506
  derived and/or modified sequence opt2 from hemagglutinin__InfluenzaA__AGW02001

SEQ ID NO: 102084 - RNA, 1701 nt, Artificial Sequence; identical to SEQ ID NO: 101506
  derived and/or modified sequence opt2 from hemagglutinin__InfluenzaA__AGW02013

SEQ ID NO: 102085 - RNA, 1701 nt, Artificial Sequence; identical to SEQ ID NO: 101370
  derived and/or modified sequence opt2 from hemagglutinin__InfluenzaA__AGW02025

SEQ ID NO: 102086 - RNA, 1701 nt, Artificial Sequence; identical to SEQ ID NO: 101506
  derived and/or modified sequence opt2 from hemagglutinin__InfluenzaA__AGW02037

SEQ ID NO: 102087 - RNA, 1701 nt, Artificial Sequence; identical to SEQ ID NO: 101506
  derived and/or modified sequence opt2 from hemagglutinin__InfluenzaA__AGW02061

SEQ ID NO: 102088 - RNA, 1701 nt, Artificial Sequence; identical to SEQ ID NO: 101506
  derived and/or modified sequence opt2 from hemagglutinin__InfluenzaA__AGW02073

SEQ ID NO: 102089 - RNA, 1701 nt, Artificial Sequence; identical to SEQ ID NO: 101506
  derived and/or modified sequence opt2 from hemagglutinin__InfluenzaA__AGW02085

SEQ ID NO: 102090 - RNA, 1701 nt, Artificial Sequence; identical to SEQ ID NO: 101395
  derived and/or modified sequence opt2 from hemagglutinin__InfluenzaA__AGW02097

SEQ ID NO: 102091 - RNA, 1701 nt, Artificial Sequence; identical to SEQ ID NO: 101370
  derived and/or modified sequence opt2 from hemagglutinin__InfluenzaA__AGW02109

SEQ ID NO: 102092 - RNA, 1701 nt, Artificial Sequence; identical to SEQ ID NO: 101506
  derived and/or modified sequence opt2 from hemagglutinin__InfluenzaA__AGW02133

SEQ ID NO: 102093 - RNA, 1701 nt, Artificial Sequence; identical to SEQ ID NO: 101506
  derived and/or modified sequence opt2 from hemagglutinin__InfluenzaA__AGW02157

SEQ ID NO: 102094 - RNA, 1701 nt, Artificial Sequence; identical to SEQ ID NO: 101370
  derived and/or modified sequence opt2 from hemagglutinin__InfluenzaA__AGW02169

SEQ ID NO: 102095 - RNA, 1701 nt, Artificial Sequence; identical to SEQ ID NO: 101506
  derived and/or modified sequence opt2 from hemagglutinin__InfluenzaA__AGW02181

SEQ ID NO: 102096 - RNA, 1701 nt, Artificial Sequence; identical to SEQ ID NO: 101380
  derived and/or modified sequence opt2 from hemagglutinin__InfluenzaA__AGW02193

SEQ ID NO: 102097 - RNA, 1701 nt, Artificial Sequence; identical to SEQ ID NO: 101347
  derived and/or modified sequence opt2 from hemagglutinin__InfluenzaA__AGW04171

SEQ ID NO: 102098 - RNA, 1707 nt, Artificial Sequence
  derived and/or modified sequence opt2 from hemagglutinin__InfluenzaA__AGW27061
auggagaagaucguccuccucuucgccaucgucaaccucgucaaguccgaccacaucugcaucggcuaccacgccaacaacuccaccgagcaggucgacaccaucauggagaagaacgucaccgucacccacgcccaggacauccucgagaagacccacaacggcaagcucugcgaccucaacggcgucaagccccucauccucaaggacugcuccgucgccggcuggcuccucggcaaccccaugugcgacgaguucaucgacguccccgagugguccuacaucgucgagaaggccaaccccgccaacgaccucugcuaccccggcaacuucaacgacuacgaggagcucaagcaccuccucucccgcaucaaccacuucgagaagauccgcaucauccccaaggacuccuggcccgaccacgaggccucccucggcgucuccgccgccugcuccuaccagggcaacuccuccuucuuccgcaacgucgucuggcuccucaagaagaacgacgccuaccccaucaucaagaaguccuacaacaacaccaacaaggaggaccuccucguccucuggggcauccaccaccccaacgacgaggccgagcagauccgccucuaccagaaccccaccaccuacgucuccaccggcaccuccacccucaaccagcgccucgucccccgcaucgccacccgcuccaaggucaacggccaguccggccgcaucgacuucuucuggaccauccucaagcccaacgacgccaucaacuucgaguccaacggcaacuucaucgcccccgaguacgccuacaagaucgucaagaagggcgacuccaccaucaugcgcuccgaggucgaguacggcaacugcuccacccgcugccagacccccaugggcgccaucaacuccuccaugcccuuccacaacauccacccccucaccaucggcgagugccccaaguacgucaaguccaacaagcucguccucgccaccggccuccgcaacuccccccagaucgagcgccgccgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucguccucuccaucauggucgccggccucucccucuggaugugcuccaacggcucccuccagugccgcaugugcaucuga

SEQ ID NO: 102099 - RNA, 1698 nt, Artificial Sequence
  derived and/or modified sequence opt2 from hemagglutinin__InfluenzaA__AGY14471
augaaggucaagcuccucauccuccucugcaccuucaccgccaccuacgccgacaccaucugcaucggcuaccacgccaacaacuccaccgacaccgucgacaccauccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcggccuccucauccccaaggaguccugguccuacaucgucgagacccccaaccccgagaacggcaccugcuaccccggcuacuucgacgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucauccucuggggcguccaccaccccuccaacaucggcaaccagcgcacccucuaccacaccgagaacaccuacgucuccgucgucuccucccacuacucccgccgcuucacccccgagaucaccaagcgccccaagguccgcgaccaggagggccgcaucaacuacuacuggacccuccucgagcccggcgacaccaucaucuucgaggccaacggcaaccucaucgcccccugguacgccuucgcccucuccaagggcuucggcuccggcaucaucaccuccaacgcccccauggacgagugcgacgccaagugccagaccccccagggcgccaucaacuccaaccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccaggaguccacccagaacgccaucaacggcaucaccaacaaggucaacuccgucaucgagaagaugaacacccaguucaccgucgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaugaaccucuacgagaaggucaagggccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 102100 - RNA, 1698 nt, Artificial Sequence; identical to SEQ ID NO: 102099
  derived and/or modified sequence opt2 from hemagglutinin__InfluenzaA__AGY14477

SEQ ID NO: 102101 - RNA, 1701 nt, Artificial Sequence
  derived and/or modified sequence opt2 from hemagglutinin__InfluenzaA__AHC57459
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccgccggccgcaucaccgucuccaccaagcgcucccagcaggccgucauccccaacaucggcucccgcccccgcauccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102102 - RNA, 1701 nt, Artificial Sequence; identical to SEQ ID NO: 98494
  derived and/or modified sequence opt2 from hemagglutinin__InfluenzaA__AHC57465

SEQ ID NO: 102103 - RNA, 1701 nt, Artificial Sequence; identical to SEQ ID NO: 98367
  derived and/or modified sequence opt2 from hemagglutinin__InfluenzaA__AHC57487

SEQ ID NO: 102104 - RNA, 1701 nt, Artificial Sequence; identical to SEQ ID NO: 99294
  derived and/or modified sequence opt2 from hemagglutinin__InfluenzaA__AHC57499

SEQ ID NO: 102105 - RNA, 1701 nt, Artificial Sequence; identical to SEQ ID NO: 99294
  derived and/or modified sequence opt2 from hemagglutinin__InfluenzaA__AHC57511

SEQ ID NO: 102106 - RNA, 1701 nt, Artificial Sequence; identical to SEQ ID NO: 99294
  derived and/or modified sequence opt2 from hemagglutinin__InfluenzaA__AHC57523

SEQ ID NO: 102107 - RNA, 1701 nt, Artificial Sequence; identical to SEQ ID NO: 98494
  derived and/or modified sequence opt2 from hemagglutinin__InfluenzaA__AHC57675

SEQ ID NO: 102108 - RNA, 1701 nt, Artificial Sequence; identical to SEQ ID NO: 98494
  derived and/or modified sequence opt2 from hemagglutinin__InfluenzaA__AHC57827

SEQ ID NO: 102109 - RNA, 1701 nt, Artificial Sequence; identical to SEQ ID NO: 98367
  derived and/or modified sequence opt2 from hemagglutinin__InfluenzaA__AHC57956

SEQ ID NO: 102110 - RNA, 1701 nt, Artificial Sequence
  derived and/or modified sequence opt2 from hemagglutinin__InfluenzaA__AHC57981
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccagaucgaggucaccaacgccaccgagcucguccagaacuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaaccucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102111 - RNA, 1701 nt, Artificial Sequence; identical to SEQ ID NO: 99294
  derived and/or modified sequence opt2 from hemagglutinin__InfluenzaA__AHC57993

SEQ ID NO: 102112 - RNA, 1701 nt, Artificial Sequence; identical to SEQ ID NO: 100586
  derived and/or modified sequence opt2 from hemagglutinin__InfluenzaA__AHC58005

SEQ ID NO: 102113 - RNA, 1701 nt, Artificial Sequence
  derived and/or modified sequence opt2 from hemagglutinin__InfluenzaA__AHC58017
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccgccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucgucuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102114 - RNA, 1701 nt, Artificial Sequence
  derived and/or modified sequence opt2 from hemagglutinin__InfluenzaA__AHC58029
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcggcuccaacaacuccuucuucucccgccucaacuggcucacccagcucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102115 - RNA, 1701 nt, Artificial Sequence
  derived and/or modified sequence opt2 from hemagglutinin__InfluenzaA__AHC58050
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccacccgccgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102116 - RNA, 1701 nt, Artificial Sequence; identical to SEQ ID NO: 99294
  derived and/or modified sequence opt2 from hemagglutinin__InfluenzaA__AHC58074

SEQ ID NO: 102117 - RNA, 1701 nt, Artificial Sequence; identical to SEQ ID NO: 99294
  derived and/or modified sequence opt2 from hemagglutinin__InfluenzaA__AHC58098

SEQ ID NO: 102118 - RNA, 1701 nt, Artificial Sequence; identical to SEQ ID NO: 99294
  derived and/or modified sequence opt2 from hemagglutinin__InfluenzaA__AHC58110

SEQ ID NO: 102119 - RNA, 1701 nt, Artificial Sequence; identical to SEQ ID NO: 99294
  derived and/or modified sequence opt2 from hemagglutinin__InfluenzaA__AHC58126

SEQ ID NO: 102120 - RNA, 1701 nt, Artificial Sequence; identical to SEQ ID NO: 99294
  derived and/or modified sequence opt2 from hemagglutinin__InfluenzaA__AHC58138

SEQ ID NO: 102121 - RNA, 1701 nt, Artificial Sequence; identical to SEQ ID NO: 99294
  derived and/or modified sequence opt2 from hemagglutinin__InfluenzaA__AHC58162

SEQ ID NO: 102122 - RNA, 1701 nt, Artificial Sequence; identical to SEQ ID NO: 100586
  derived and/or modified sequence opt2 from hemagglutinin__InfluenzaA__AHC58186

SEQ ID NO: 102123 - RNA, 1701 nt, Artificial Sequence
  derived and/or modified sequence opt2 from hemagglutinin__InfluenzaA__AHC58198
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccagaaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggacugccagaagggcaacauccgcugcaacaucugcaucuga

SEQ ID NO: 102124 - RNA, 1701 nt, Artificial Sequence
  derived and/or modified sequence opt2 from hemagglutinin__InfluenzaA__AHC58210
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102125 - RNA, 1701 nt, Artificial Sequence; identical to SEQ ID NO: 98494
  derived and/or modified sequence opt2 from hemagglutinin__InfluenzaA__AHC58234

SEQ ID NO: 102126 - RNA, 1701 nt, Artificial Sequence; identical to SEQ ID NO: 99294
  derived and/or modified sequence opt2 from hemagglutinin__InfluenzaA__AHC58246

SEQ ID NO: 102127 - RNA, 1701 nt, Artificial Sequence; identical to SEQ ID NO: 98494
  derived and/or modified sequence opt2 from hemagglutinin__InfluenzaA__AHC58258

SEQ ID NO: 102128 - RNA, 1701 nt, Artificial Sequence; identical to SEQ ID NO: 98367
  derived and/or modified sequence opt2 from hemagglutinin__InfluenzaA__AHC58270

SEQ ID NO: 102129 - RNA, 1701 nt, Artificial Sequence
  derived and/or modified sequence opt2 from hemagglutinin__InfluenzaA__AHC58372
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucacccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102130 - RNA, 1701 nt, Artificial Sequence
  derived and/or modified sequence opt2 from hemagglutinin__InfluenzaA__AHC58396
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcggcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102131 - RNA, 1701 nt, Artificial Sequence; identical to SEQ ID NO: 99294
  derived and/or modified sequence opt2 from hemagglutinin__InfluenzaA__AHC58408

SEQ ID NO: 102132 - RNA, 1701 nt, Artificial Sequence; identical to SEQ ID NO: 100586
  derived and/or modified sequence opt2 from hemagglutinin__InfluenzaA__AHC58420

SEQ ID NO: 102133 - RNA, 1701 nt, Artificial Sequence; identical to SEQ ID NO: 100586
  derived and/or modified sequence opt2 from hemagglutinin__InfluenzaA__AHC58432

SEQ ID NO: 102134 - RNA, 1701 nt, Artificial Sequence; identical to SEQ ID NO: 98494
  derived and/or modified sequence opt2 from hemagglutinin__InfluenzaA__AHC58444

SEQ ID NO: 102135 - RNA, 1701 nt, Artificial Sequence; identical to SEQ ID NO: 102130
  derived and/or modified sequence opt2 from hemagglutinin__InfluenzaA__AHC58456

SEQ ID NO: 102136 - RNA, 1701 nt, Artificial Sequence
  derived and/or modified sequence opt2 from hemagglutinin__InfluenzaA__AHC58468
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccaggccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccguccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgcccagggcuccggcuacgccgccgaccucaaguccacccagaacgccaucgacaagaucaccaacaaggucaacuccgucaucgagaagaugaacacccaguucaccgccgucggcaaggaguucaaccaccucgagcgccgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102137 - RNA, 1701 nt, Artificial Sequence
  derived and/or modified sequence opt2 from hemagglutinin__InfluenzaA__AHC58479
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcgagaucugcgacuccccccaccagaucaucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuucaagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102138 - RNA, 1701 nt, Artificial Sequence; identical to SEQ ID NO: 102130
  derived and/or modified sequence opt2 from hemagglutinin__InfluenzaA__AHC58491

SEQ ID NO: 102139 - RNA, 1701 nt, Artificial Sequence; identical to SEQ ID NO: 98494
  derived and/or modified sequence opt2 from hemagglutinin__InfluenzaA__AHC58515

SEQ ID NO: 102140 - RNA, 1701 nt, Artificial Sequence; identical to SEQ ID NO: 99294
  derived and/or modified sequence opt2 from hemagglutinin__InfluenzaA__AHC58527

SEQ ID NO: 102141 - RNA, 1701 nt, Artificial Sequence
  derived and/or modified sequence opt2 from hemagglutinin__InfluenzaA__AHC58563
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcgagaucugcgacuccccccaccagaucaucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102142 - RNA, 1701 nt, Artificial Sequence; identical to SEQ ID NO: 99294
  derived and/or modified sequence opt2 from hemagglutinin__InfluenzaA__AHC58575

SEQ ID NO: 102143 - RNA, 1701 nt, Artificial Sequence; identical to SEQ ID NO: 98367
  derived and/or modified sequence opt2 from hemagglutinin__InfluenzaA__AHC58587

SEQ ID NO: 102144 - RNA, 1701 nt, Artificial Sequence; identical to SEQ ID NO: 98494
  derived and/or modified sequence opt2 from hemagglutinin__InfluenzaA__AHC58599

SEQ ID NO: 102145 - RNA, 1701 nt, Artificial Sequence; identical to SEQ ID NO: 99294
  derived and/or modified sequence opt2 from hemagglutinin__InfluenzaA__AHC58611

SEQ ID NO: 102146 - RNA, 1701 nt, Artificial Sequence; identical to SEQ ID NO: 99294
  derived and/or modified sequence opt2 from hemagglutinin__InfluenzaA__AHC58623

SEQ ID NO: 102147 - RNA, 1701 nt, Artificial Sequence; identical to SEQ ID NO: 99294
  derived and/or modified sequence opt2 from hemagglutinin__InfluenzaA__AHC58647

SEQ ID NO: 102148 - RNA, 1701 nt, Artificial Sequence; identical to SEQ ID NO: 98494
  derived and/or modified sequence opt2 from hemagglutinin__InfluenzaA__AHC58659

SEQ ID NO: 102149 - RNA, 1701 nt, Artificial Sequence; identical to SEQ ID NO: 98367
  derived and/or modified sequence opt2 from hemagglutinin__InfluenzaA__AHC58671

SEQ ID NO: 102150 - RNA, 1701 nt, Artificial Sequence; identical to SEQ ID NO: 100586
  derived and/or modified sequence opt2 from hemagglutinin__InfluenzaA__AHC58683

SEQ ID NO: 102151 - RNA, 1701 nt, Artificial Sequence; identical to SEQ ID NO: 98367
  derived and/or modified sequence opt2 from hemagglutinin__InfluenzaA__AHC58695

SEQ ID NO: 102152 - RNA, 1701 nt, Artificial Sequence; identical to SEQ ID NO: 100586
  derived and/or modified sequence opt2 from hemagglutinin__InfluenzaA__AHC58707

SEQ ID NO: 102153 - RNA, 1701 nt, Artificial Sequence; identical to SEQ ID NO: 100586
  derived and/or modified sequence opt2 from hemagglutinin__InfluenzaA__AHC58719

SEQ ID NO: 102154 - RNA, 1701 nt, Artificial Sequence; identical to SEQ ID NO: 102130
  derived and/or modified sequence opt2 from hemagglutinin__InfluenzaA__AHC58731

SEQ ID NO: 102155 - RNA, 1701 nt, Artificial Sequence
  derived and/or modified sequence opt2 from hemagglutinin__InfluenzaA__AHC58743
augaagaccaucaucgccugguccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102156 - RNA, 1701 nt, Artificial Sequence; identical to SEQ ID NO: 102130
  derived and/or modified sequence opt2 from hemagglutinin__InfluenzaA__AHC58755

SEQ ID NO: 102157 - RNA, 1701 nt, Artificial Sequence; identical to SEQ ID NO: 98367
  derived and/or modified sequence opt2 from hemagglutinin__InfluenzaA__AHC58779

SEQ ID NO: 102158 - RNA, 1701 nt, Artificial Sequence; identical to SEQ ID NO: 102129
  derived and/or modified sequence opt2 from hemagglutinin__InfluenzaA__AHC58791

SEQ ID NO: 102159 - RNA, 1701 nt, Artificial Sequence
  derived and/or modified sequence opt2 from hemagglutinin__InfluenzaA__AHC58803
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcgagaucugcgacuccccccaccagaucaucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugaaguccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuucaagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102160 - RNA, 1701 nt, Artificial Sequence
  derived and/or modified sequence opt2 from hemagglutinin__InfluenzaA__AHC58815
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcggcaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102161 - RNA, 1701 nt, Artificial Sequence; identical to SEQ ID NO: 98367
  derived and/or modified sequence opt2 from hemagglutinin__InfluenzaA__AHC58827

SEQ ID NO: 102162 - RNA, 1701 nt, Artificial Sequence; identical to SEQ ID NO: 99294
  derived and/or modified sequence opt2 from hemagglutinin__InfluenzaA__AHC58839

SEQ ID NO: 102163 - RNA, 1701 nt, Artificial Sequence
  derived and/or modified sequence opt2 from hemagglutinin__InfluenzaA__AHC58863
augaagaccaucaucgcccucuccuacauccucugccucgucuucgcccagaagcuccccggcaacgacaacuccaccgccacccucugccucggccaccacgccgucuccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcggcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102164 - RNA, 1701 nt, Artificial Sequence; identical to SEQ ID NO: 98367
  derived and/or modified sequence opt2 from hemagglutinin__InfluenzaA__AHC58875

SEQ ID NO: 102165 - RNA, 1701 nt, Artificial Sequence; identical to SEQ ID NO: 99294
  derived and/or modified sequence opt2 from hemagglutinin__InfluenzaA__AHC58887

SEQ ID NO: 102166 - RNA, 1701 nt, Artificial Sequence; identical to SEQ ID NO: 102130
  derived and/or modified sequence opt2 from hemagglutinin__InfluenzaA__AHC58899

SEQ ID NO: 102167 - RNA, 1701 nt, Artificial Sequence; identical to SEQ ID NO: 99294
  derived and/or modified sequence opt2 from hemagglutinin__InfluenzaA__AHC58981

SEQ ID NO: 102168 - RNA, 1701 nt, Artificial Sequence; identical to SEQ ID NO: 99294
  derived and/or modified sequence opt2 from hemagglutinin__InfluenzaA__AHC58993

SEQ ID NO: 102169 - RNA, 1701 nt, Artificial Sequence; identical to SEQ ID NO: 99294
  derived and/or modified sequence opt2 from hemagglutinin__InfluenzaA__AHC59005

SEQ ID NO: 102170 - RNA, 1701 nt, Artificial Sequence
  derived and/or modified sequence opt2 from hemagglutinin__InfluenzaA__AHC59017
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcggcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagauguccaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102171 - RNA, 1701 nt, Artificial Sequence; identical to SEQ ID NO: 102130
  derived and/or modified sequence opt2 from hemagglutinin__InfluenzaA__AHC59029

SEQ ID NO: 102172 - RNA, 1701 nt, Artificial Sequence; identical to SEQ ID NO: 98494
  derived and/or modified sequence opt2 from hemagglutinin__InfluenzaA__AHC59041

SEQ ID NO: 102173 - RNA, 1701 nt, Artificial Sequence
  derived and/or modified sequence opt2 from hemagglutinin__InfluenzaA__AHC59053
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccgccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucauguggaccugccagaagggcaacauccgcugcaacaucugcaucuga

SEQ ID NO: 102174 - RNA, 1701 nt, Artificial Sequence
  derived and/or modified sequence opt2 from hemagglutinin__InfluenzaA__AHC59077
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 102175 - RNA, 1701 nt, Artificial Sequence; identical to SEQ ID NO: 100586
  derived and/or modified sequence opt2 from hemagglutinin__InfluenzaA__AHC59089

SEQ ID NO: 102176 - RNA, 1701 nt, Artificial Sequence; identical to SEQ ID NO: 99294
  derived and/or modified sequence opt2 from hemagglutinin__InfluenzaA__AHC59101

SEQ ID NO: 102177 - RNA, 1701 nt, Artificial Sequence; identical to SEQ ID NO: 98494
  derived and/or modified sequence opt2 from hemagglutinin__InfluenzaA__AHC59113

SEQ ID NO: 102178 - RNA, 1701 nt, Artificial Sequence; identical to SEQ ID NO: 99294
  derived and/or modified sequence opt2 from hemagglutinin__InfluenzaA__AHC59125

SEQ ID NO: 102179 - RNA, 1701 nt, Artificial Sequence
  derived and/or modified sequence opt2 from hemagglutinin__InfluenzaA__AHC59137
augaagaccaucaucgcccucuccuacauccucugccucgucuucgcccagaagauccccggcaacgacaacuccaccgccacccucugccucggccaccacgccgucuccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcggcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102180 - RNA, 1701 nt, Artificial Sequence; identical to SEQ ID NO: 98494
  derived and/or modified sequence opt2 from hemagglutinin__InfluenzaA__AHC59149

SEQ ID NO: 102181 - RNA, 1701 nt, Artificial Sequence
  derived and/or modified sequence opt2 from hemagglutinin__InfluenzaA__AHC59185
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102182 - RNA, 1701 nt, Artificial Sequence; identical to SEQ ID NO: 98367
  derived and/or modified sequence opt2 from hemagglutinin__InfluenzaA__AHC59197

SEQ ID NO: 102183 - RNA, 1701 nt, Artificial Sequence
  derived and/or modified sequence opt2 from hemagglutinin__InfluenzaA__AHC59209
augaagaccaucaucgcccucuccuacauccucugccucgucuucgcccaggagauccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacgacuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcgagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgccgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102184 - RNA, 1701 nt, Artificial Sequence; identical to SEQ ID NO: 98494
  derived and/or modified sequence opt2 from hemagglutinin__InfluenzaA__AHC59221

SEQ ID NO: 102185 - RNA, 1701 nt, Artificial Sequence; identical to SEQ ID NO: 102163
  derived and/or modified sequence opt2 from hemagglutinin__InfluenzaA__AHC59245

SEQ ID NO: 102186 - RNA, 1701 nt, Artificial Sequence; identical to SEQ ID NO: 102130
  derived and/or modified sequence opt2 from hemagglutinin__InfluenzaA__AHC59257

SEQ ID NO: 102187 - RNA, 1701 nt, Artificial Sequence; identical to SEQ ID NO: 99294
  derived and/or modified sequence opt2 from hemagglutinin__InfluenzaA__AHC59269

SEQ ID NO: 102188 - RNA, 1701 nt, Artificial Sequence; identical to SEQ ID NO: 102130
  derived and/or modified sequence opt2 from hemagglutinin__InfluenzaA__AHC59281

SEQ ID NO: 102189 - RNA, 1701 nt, Artificial Sequence; identical to SEQ ID NO: 98494
  derived and/or modified sequence opt2 from hemagglutinin__InfluenzaA__AHC59293

SEQ ID NO: 102190 - RNA, 1701 nt, Artificial Sequence
  derived and/or modified sequence opt2 from hemagglutinin__InfluenzaA__AHC59305
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcuccuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102191 - RNA, 1701 nt, Artificial Sequence
  derived and/or modified sequence opt2 from hemagglutinin__InfluenzaA__AHC59329
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgagaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102192 - RNA, 1701 nt, Artificial Sequence; identical to SEQ ID NO: 100586
  derived and/or modified sequence opt2 from hemagglutinin__InfluenzaA__AHC59341

SEQ ID NO: 102193 - RNA, 1701 nt, Artificial Sequence; identical to SEQ ID NO: 102130
  derived and/or modified sequence opt2 from hemagglutinin__InfluenzaA__AHC59365

SEQ ID NO: 102194 - RNA, 1701 nt, Artificial Sequence
  derived and/or modified sequence opt2 from hemagglutinin__InfluenzaA__AHC59377
augaagaccaucaucgcccucuccuacauccucugccucgucuucgcccagaagcuccccggcaacgacaacuccaccgccacccucugccucggccaccacgccguccccaacggcaccgucgucaagaccaucaccaacgaccagaucgaggucaccaacgccaccgagcucguccagaacuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccagaaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102195 - RNA, 1701 nt, Artificial Sequence; identical to SEQ ID NO: 98494
  derived and/or modified sequence opt2 from hemagglutinin__InfluenzaA__AHC59413

SEQ ID NO: 102196 - RNA, 1701 nt, Artificial Sequence; identical to SEQ ID NO: 99294
  derived and/or modified sequence opt2 from hemagglutinin__InfluenzaA__AHC59425

SEQ ID NO: 102197 - RNA, 1701 nt, Artificial Sequence; identical to SEQ ID NO: 100586
  derived and/or modified sequence opt2 from hemagglutinin__InfluenzaA__AHC59437

SEQ ID NO: 102198 - RNA, 1701 nt, Artificial Sequence
  derived and/or modified sequence opt2 from hemagglutinin__InfluenzaA__AHC59449
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcggcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggccgcaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102199 - RNA, 1701 nt, Artificial Sequence; identical to SEQ ID NO: 98367
  derived and/or modified sequence opt2 from hemagglutinin__InfluenzaA__AHC59461

SEQ ID NO: 102200 - RNA, 1701 nt, Artificial Sequence; identical to SEQ ID NO: 102191
  derived and/or modified sequence opt2 from hemagglutinin__InfluenzaA__AHC59473

SEQ ID NO: 102201 - RNA, 1701 nt, Artificial Sequence; identical to SEQ ID NO: 98494
  derived and/or modified sequence opt2 from hemagglutinin__InfluenzaA__AHC59485

SEQ ID NO: 102202 - RNA, 1701 nt, Artificial Sequence; identical to SEQ ID NO: 98494
  derived and/or modified sequence opt2 from hemagglutinin__InfluenzaA__AHC59497

SEQ ID NO: 102203 - RNA, 1701 nt, Artificial Sequence; identical to SEQ ID NO: 98367
  derived and/or modified sequence opt2 from hemagglutinin__InfluenzaA__AHC59509

SEQ ID NO: 102204 - RNA, 1701 nt, Artificial Sequence; identical to SEQ ID NO: 98367
  derived and/or modified sequence opt2 from hemagglutinin__InfluenzaA__AHC59521

SEQ ID NO: 102205 - RNA, 1701 nt, Artificial Sequence
  derived and/or modified sequence opt2 from hemagglutinin__InfluenzaA__AHC59533
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaagaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102206 - RNA, 1701 nt, Artificial Sequence; identical to SEQ ID NO: 98494
  derived and/or modified sequence opt2 from hemagglutinin__InfluenzaA__AHC59545

SEQ ID NO: 102207 - RNA, 1701 nt, Artificial Sequence; identical to SEQ ID NO: 102130
  derived and/or modified sequence opt2 from hemagglutinin__InfluenzaA__AHC59557

SEQ ID NO: 102208 - RNA, 1701 nt, Artificial Sequence
  derived and/or modified sequence opt2 from hemagglutinin__InfluenzaA__AHC59569
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102209 - RNA, 1701 nt, Artificial Sequence; identical to SEQ ID NO: 98494
  derived and/or modified sequence opt2 from hemagglutinin__InfluenzaA__AHC59581

SEQ ID NO: 102210 - RNA, 1701 nt, Artificial Sequence; identical to SEQ ID NO: 98367
  derived and/or modified sequence opt2 from hemagglutinin__InfluenzaA__AHC59593

SEQ ID NO: 102211 - RNA, 1701 nt, Artificial Sequence; identical to SEQ ID NO: 100586
  derived and/or modified sequence opt2 from hemagglutinin__InfluenzaA__AHC59605

SEQ ID NO: 102212 - RNA, 1701 nt, Artificial Sequence; identical to SEQ ID NO: 98494
  derived and/or modified sequence opt2 from hemagglutinin__InfluenzaA__AHC59617

SEQ ID NO: 102213 - RNA, 1701 nt, Artificial Sequence; identical to SEQ ID NO: 98494
  derived and/or modified sequence opt2 from hemagglutinin__InfluenzaA__AHC59629

SEQ ID NO: 102214 - RNA, 1701 nt, Artificial Sequence; identical to SEQ ID NO: 102130
  derived and/or modified sequence opt2 from hemagglutinin__InfluenzaA__AHC59641

SEQ ID NO: 102215 - RNA, 1701 nt, Artificial Sequence
  derived and/or modified sequence opt2 from hemagglutinin__InfluenzaA__AHC59653
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccacccagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102216 - RNA, 1701 nt, Artificial Sequence; identical to SEQ ID NO: 98367
  derived and/or modified sequence opt2 from hemagglutinin__InfluenzaA__AHC59665

SEQ ID NO: 102217 - RNA, 1701 nt, Artificial Sequence; identical to SEQ ID NO: 98494
  derived and/or modified sequence opt2 from hemagglutinin__InfluenzaA__AHC59677

SEQ ID NO: 102218 - RNA, 1701 nt, Artificial Sequence; identical to SEQ ID NO: 102215
  derived and/or modified sequence opt2 from hemagglutinin__InfluenzaA__AHC59689

SEQ ID NO: 102219 - RNA, 1701 nt, Artificial Sequence; identical to SEQ ID NO: 102130
  derived and/or modified sequence opt2 from hemagglutinin__InfluenzaA__AHC59701

SEQ ID NO: 102220 - RNA, 1701 nt, Artificial Sequence; identical to SEQ ID NO: 98367
  derived and/or modified sequence opt2 from hemagglutinin__InfluenzaA__AHC59713

SEQ ID NO: 102221 - RNA, 1701 nt, Artificial Sequence; identical to SEQ ID NO: 102141
  derived and/or modified sequence opt2 from hemagglutinin__InfluenzaA__AHC59737

SEQ ID NO: 102222 - RNA, 1701 nt, Artificial Sequence; identical to SEQ ID NO: 98367
  derived and/or modified sequence opt2 from hemagglutinin__InfluenzaA__AHC59749

SEQ ID NO: 102223 - RNA, 1701 nt, Artificial Sequence; identical to SEQ ID NO: 98494
  derived and/or modified sequence opt2 from hemagglutinin__InfluenzaA__AHC59761

SEQ ID NO: 102224 - RNA, 1701 nt, Artificial Sequence; identical to SEQ ID NO: 98494
  derived and/or modified sequence opt2 from hemagglutinin__InfluenzaA__AHC59773

SEQ ID NO: 102225 - RNA, 1701 nt, Artificial Sequence; identical to SEQ ID NO: 99294
  derived and/or modified sequence opt2 from hemagglutinin__InfluenzaA__AHC59785

SEQ ID NO: 102226 - RNA, 1701 nt, Artificial Sequence; identical to SEQ ID NO: 98494
  derived and/or modified sequence opt2 from hemagglutinin__InfluenzaA__AHC59797

SEQ ID NO: 102227 - RNA, 1701 nt, Artificial Sequence; identical to SEQ ID NO: 100586
  derived and/or modified sequence opt2 from hemagglutinin__InfluenzaA__AHC59809

SEQ ID NO: 102228 - RNA, 1701 nt, Artificial Sequence
  derived and/or modified sequence opt2 from hemagglutinin__InfluenzaA__AHC59821
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcgagaucugcgacuccccccaccagauccucgacggcgagaacugcacccucaucgacgcccuccucggcgacccccagugcgacggccuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucgucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102229 - RNA, 1701 nt, Artificial Sequence; identical to SEQ ID NO: 102130
  derived and/or modified sequence opt2 from hemagglutinin__InfluenzaA__AHC59833

SEQ ID NO: 102230 - RNA, 1701 nt, Artificial Sequence; identical to SEQ ID NO: 102129
  derived and/or modified sequence opt2 from hemagglutinin__InfluenzaA__AHC59845

SEQ ID NO: 102231 - RNA, 1701 nt, Artificial Sequence; identical to SEQ ID NO: 99294
  derived and/or modified sequence opt2 from hemagglutinin__InfluenzaA__AHC59857

SEQ ID NO: 102232 - RNA, 1701 nt, Artificial Sequence; identical to SEQ ID NO: 98494
  derived and/or modified sequence opt2 from hemagglutinin__InfluenzaA__AHC59869

SEQ ID NO: 102233 - RNA, 1701 nt, Artificial Sequence; identical to SEQ ID NO: 98494
  derived and/or modified sequence opt2 from hemagglutinin__InfluenzaA__AHC59881

SEQ ID NO: 102234 - RNA, 1701 nt, Artificial Sequence; identical to SEQ ID NO: 98367
  derived and/or modified sequence opt2 from hemagglutinin__InfluenzaA__AHC59892

SEQ ID NO: 102235 - RNA, 1701 nt, Artificial Sequence
  derived and/or modified sequence opt2 from hemagglutinin__InfluenzaA__AHC59904
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcggcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102236 - RNA, 1701 nt, Artificial Sequence
  derived and/or modified sequence opt2 from hemagglutinin__InfluenzaA__AHC59915
augaagaccgucaucgcccucuccuacauccucugccucgccuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102237 - RNA, 1701 nt, Artificial Sequence; identical to SEQ ID NO: 98494
  derived and/or modified sequence opt2 from hemagglutinin__InfluenzaA__AHC59939

SEQ ID NO: 102238 - RNA, 1701 nt, Artificial Sequence
  derived and/or modified sequence opt2 from hemagglutinin__InfluenzaA__AHC59963
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacaucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102239 - RNA, 1701 nt, Artificial Sequence; identical to SEQ ID NO: 98367
  derived and/or modified sequence opt2 from hemagglutinin__InfluenzaA__AHC59987

SEQ ID NO: 102240 - RNA, 1701 nt, Artificial Sequence; identical to SEQ ID NO: 98367
  derived and/or modified sequence opt2 from hemagglutinin__InfluenzaA__AHC59999

SEQ ID NO: 102241 - RNA, 1701 nt, Artificial Sequence; identical to SEQ ID NO: 98494
  derived and/or modified sequence opt2 from hemagglutinin__InfluenzaA__AHC60011

SEQ ID NO: 102242 - RNA, 1701 nt, Artificial Sequence; identical to SEQ ID NO: 98367
  derived and/or modified sequence opt2 from hemagglutinin__InfluenzaA__AHC60023

SEQ ID NO: 102243 - RNA, 1701 nt, Artificial Sequence; identical to SEQ ID NO: 99294
  derived and/or modified sequence opt2 from hemagglutinin__InfluenzaA__AHC60035

SEQ ID NO: 102244 - RNA, 1701 nt, Artificial Sequence; identical to SEQ ID NO: 99294
  derived and/or modified sequence opt2 from hemagglutinin__InfluenzaA__AHC60047

SEQ ID NO: 102245 - RNA, 1701 nt, Artificial Sequence
  derived and/or modified sequence opt2 from hemagglutinin__InfluenzaA__AHC60059
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102246 - RNA, 1701 nt, Artificial Sequence; identical to SEQ ID NO: 100586
  derived and/or modified sequence opt2 from hemagglutinin__InfluenzaA__AHC60071

SEQ ID NO: 102247 - RNA, 1701 nt, Artificial Sequence; identical to SEQ ID NO: 102130
  derived and/or modified sequence opt2 from hemagglutinin__InfluenzaA__AHC60083

SEQ ID NO: 102248 - RNA, 1701 nt, Artificial Sequence; identical to SEQ ID NO: 99294
  derived and/or modified sequence opt2 from hemagglutinin__InfluenzaA__AHC60095

SEQ ID NO: 102249 - RNA, 1701 nt, Artificial Sequence
  derived and/or modified sequence opt2 from hemagglutinin__InfluenzaA__AHC60107
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcgagaucugcgacuccccccaccagaucaucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuucaagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102250 - RNA, 1701 nt, Artificial Sequence; identical to SEQ ID NO: 98494
  derived and/or modified sequence opt2 from hemagglutinin__InfluenzaA__AHC60119

SEQ ID NO: 102251 - RNA, 1701 nt, Artificial Sequence; identical to SEQ ID NO: 98494
  derived and/or modified sequence opt2 from hemagglutinin__InfluenzaA__AHC60131

SEQ ID NO: 102252 - RNA, 1701 nt, Artificial Sequence; identical to SEQ ID NO: 102160
  derived and/or modified sequence opt2 from hemagglutinin__InfluenzaA__AHC60143

SEQ ID NO: 102253 - RNA, 1701 nt, Artificial Sequence
  derived and/or modified sequence opt2 from hemagglutinin__InfluenzaA__AHC60155
augaagaccgucaucgcccucuccuacauccucugccucgccuucgcccagaagcuccccggcaacgacaacuccaccgccacccucugccucggccaccacgccguccccaacggcaccaucgucaagaccaucaccaacgaccagaucgaggucaccaacgccaccgagcucguccaguccucccccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102254 - RNA, 1701 nt, Artificial Sequence; identical to SEQ ID NO: 98367
  derived and/or modified sequence opt2 from hemagglutinin__InfluenzaA__AHC60167

SEQ ID NO: 102255 - RNA, 1701 nt, Artificial Sequence; identical to SEQ ID NO: 99294
  derived and/or modified sequence opt2 from hemagglutinin__InfluenzaA__AHC60179

SEQ ID NO: 102256 - RNA, 1701 nt, Artificial Sequence; identical to SEQ ID NO: 102205
  derived and/or modified sequence opt2 from hemagglutinin__InfluenzaA__AHC60191

SEQ ID NO: 102257 - RNA, 1701 nt, Artificial Sequence; identical to SEQ ID NO: 102205
  derived and/or modified sequence opt2 from hemagglutinin__InfluenzaA__AHC60203

SEQ ID NO: 102258 - RNA, 1701 nt, Artificial Sequence; identical to SEQ ID NO: 100586
  derived and/or modified sequence opt2 from hemagglutinin__InfluenzaA__AHC60215

SEQ ID NO: 102259 - RNA, 1701 nt, Artificial Sequence; identical to SEQ ID NO: 99294
  derived and/or modified sequence opt2 from hemagglutinin__InfluenzaA__AHC60239

SEQ ID NO: 102260 - RNA, 1701 nt, Artificial Sequence; identical to SEQ ID NO: 99294
  derived and/or modified sequence opt2 from hemagglutinin__InfluenzaA__AHC60251

SEQ ID NO: 102261 - RNA, 1701 nt, Artificial Sequence
  derived and/or modified sequence opt2 from hemagglutinin__InfluenzaA__AHC60263
augaagaccaucaucgcccucuccuacauccucugccucgucuucgcccagaagcuccccggcaacgagaacuccaccgccacccucugccucggccaccacgccguccccaacggcaccaucgucaagaccaucaccaacgaccagaucgaggucaccaacgccaccgagcucguccagaacuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102262 - RNA, 1701 nt, Artificial Sequence; identical to SEQ ID NO: 98367
  derived and/or modified sequence opt2 from hemagglutinin__InfluenzaA__AHC60275

SEQ ID NO: 102263 - RNA, 1701 nt, Artificial Sequence; identical to SEQ ID NO: 102249
  derived and/or modified sequence opt2 from hemagglutinin__InfluenzaA__AHC60287

SEQ ID NO: 102264 - RNA, 1701 nt, Artificial Sequence; identical to SEQ ID NO: 102130
  derived and/or modified sequence opt2 from hemagglutinin__InfluenzaA__AHC60299

SEQ ID NO: 102265 - RNA, 1701 nt, Artificial Sequence
  derived and/or modified sequence opt2 from hemagglutinin__InfluenzaA__AHC60311
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucgacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102266 - RNA, 1701 nt, Artificial Sequence; identical to SEQ ID NO: 99294
  derived and/or modified sequence opt2 from hemagglutinin__InfluenzaA__AHC60323

SEQ ID NO: 102267 - RNA, 1701 nt, Artificial Sequence; identical to SEQ ID NO: 100586
  derived and/or modified sequence opt2 from hemagglutinin__InfluenzaA__AHC60335

SEQ ID NO: 102268 - RNA, 1701 nt, Artificial Sequence; identical to SEQ ID NO: 98367
  derived and/or modified sequence opt2 from hemagglutinin__InfluenzaA__AHC60347

SEQ ID NO: 102269 - RNA, 1701 nt, Artificial Sequence; identical to SEQ ID NO: 98494
  derived and/or modified sequence opt2 from hemagglutinin__InfluenzaA__AHC60359

SEQ ID NO: 102270 - RNA, 1701 nt, Artificial Sequence; identical to SEQ ID NO: 102191
  derived and/or modified sequence opt2 from hemagglutinin__InfluenzaA__AHC60371

SEQ ID NO: 102271 - RNA, 1701 nt, Artificial Sequence; identical to SEQ ID NO: 98367
  derived and/or modified sequence opt2 from hemagglutinin__InfluenzaA__AHC60383

SEQ ID NO: 102272 - RNA, 1701 nt, Artificial Sequence; identical to SEQ ID NO: 98494
  derived and/or modified sequence opt2 from hemagglutinin__InfluenzaA__AHC60395

SEQ ID NO: 102273 - RNA, 1701 nt, Artificial Sequence; identical to SEQ ID NO: 102205
  derived and/or modified sequence opt2 from hemagglutinin__InfluenzaA__AHC60407

SEQ ID NO: 102274 - RNA, 1701 nt, Artificial Sequence; identical to SEQ ID NO: 98367
  derived and/or modified sequence opt2 from hemagglutinin__InfluenzaA__AHC60419

SEQ ID NO: 102275 - RNA, 1701 nt, Artificial Sequence; identical to SEQ ID NO: 98494
  derived and/or modified sequence opt2 from hemagglutinin__InfluenzaA__AHC60431

SEQ ID NO: 102276 - RNA, 1701 nt, Artificial Sequence; identical to SEQ ID NO: 98367
  derived and/or modified sequence opt2 from hemagglutinin__InfluenzaA__AHC60455

SEQ ID NO: 102277 - RNA, 1701 nt, Artificial Sequence; identical to SEQ ID NO: 98367
  derived and/or modified sequence opt2 from hemagglutinin__InfluenzaA__AHC60467

SEQ ID NO: 102278 - RNA, 1701 nt, Artificial Sequence; identical to SEQ ID NO: 102129
  derived and/or modified sequence opt2 from hemagglutinin__InfluenzaA__AHC60479

SEQ ID NO: 102279 - RNA, 1701 nt, Artificial Sequence; identical to SEQ ID NO: 99294
  derived and/or modified sequence opt2 from hemagglutinin__InfluenzaA__AHC60491

SEQ ID NO: 102280 - RNA, 1701 nt, Artificial Sequence
  derived and/or modified sequence opt2 from hemagglutinin__InfluenzaA__AHC60503
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 102281 - RNA, 1701 nt, Artificial Sequence; identical to SEQ ID NO: 98494
  derived and/or modified sequence opt2 from hemagglutinin__InfluenzaA__AHC60515

SEQ ID NO: 102282 - RNA, 1701 nt, Artificial Sequence; identical to SEQ ID NO: 99294
  derived and/or modified sequence opt2 from hemagglutinin__InfluenzaA__AHC60527

SEQ ID NO: 102283 - RNA, 1701 nt, Artificial Sequence; identical to SEQ ID NO: 98494
  derived and/or modified sequence opt2 from hemagglutinin__InfluenzaA__AHC60539

SEQ ID NO: 102284 - RNA, 1701 nt, Artificial Sequence; identical to SEQ ID NO: 102141
  derived and/or modified sequence opt2 from hemagglutinin__InfluenzaA__AHC60551

SEQ ID NO: 102285 - RNA, 1701 nt, Artificial Sequence; identical to SEQ ID NO: 100586
  derived and/or modified sequence opt2 from hemagglutinin__InfluenzaA__AHC60563

SEQ ID NO: 102286 - RNA, 1701 nt, Artificial Sequence; identical to SEQ ID NO: 100586
  derived and/or modified sequence opt2 from hemagglutinin__InfluenzaA__AHC60575

SEQ ID NO: 102287 - RNA, 1701 nt, Artificial Sequence
  derived and/or modified sequence opt2 from hemagglutinin__InfluenzaA__AHC60587
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccagaaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102288 - RNA, 1701 nt, Artificial Sequence; identical to SEQ ID NO: 100586
  derived and/or modified sequence opt2 from hemagglutinin__InfluenzaA__AHC60599

SEQ ID NO: 102289 - RNA, 1701 nt, Artificial Sequence; identical to SEQ ID NO: 98367
  derived and/or modified sequence opt2 from hemagglutinin__InfluenzaA__AHC60611

SEQ ID NO: 102290 - RNA, 1701 nt, Artificial Sequence
  derived and/or modified sequence opt2 from hemagglutinin__InfluenzaA__AHC60623
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102291 - RNA, 1701 nt, Artificial Sequence; identical to SEQ ID NO: 100586
  derived and/or modified sequence opt2 from hemagglutinin__InfluenzaA__AHC60635

SEQ ID NO: 102292 - RNA, 1701 nt, Artificial Sequence
  derived and/or modified sequence opt2 from hemagglutinin__InfluenzaA__AHC60647
augaagaccaucaucgcccucuccuacauccucugccucgucuucacccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102293 - RNA, 1701 nt, Artificial Sequence
  derived and/or modified sequence opt2 from hemagglutinin__InfluenzaA__AHC60659
augaagaccaucaucgcccucuccuacauccucugccucgucuucacccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccgccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102294 - RNA, 1701 nt, Artificial Sequence
  derived and/or modified sequence opt2 from hemagglutinin__InfluenzaA__AHC60671
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaaggagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102295 - RNA, 1701 nt, Artificial Sequence
  derived and/or modified sequence opt2 from hemagglutinin__InfluenzaA__AHC60683
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccgccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucauccgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102296 - RNA, 1701 nt, Artificial Sequence
  derived and/or modified sequence opt2 from hemagglutinin__InfluenzaA__AHC60695
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcaugcgcggcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102297 - RNA, 1701 nt, Artificial Sequence
  derived and/or modified sequence opt2 from hemagglutinin__InfluenzaA__AHC60707
augaagaccaucaucgcccucuccuacauccucugccucgucuucgcccagaagcuccccggcaacgacaacuccaccgccacccucugccucggccaccacgccguccccaacggcaccaucgucaagaccaucaccgacgaccagaucgaggucaccaacgccaccgagcucguccagaacuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggaucaucuggaucuccuucgccaucuccugcuuccuccucugcgucgcccuccucggcuucaucaugugggccugccagaagggcaacauccgcugcaacaucugcaucuga

SEQ ID NO: 102298 - RNA, 1701 nt, Artificial Sequence; identical to SEQ ID NO: 98367
  derived and/or modified sequence opt2 from hemagglutinin__InfluenzaA__AHC60719

SEQ ID NO: 102299 - RNA, 1701 nt, Artificial Sequence; identical to SEQ ID NO: 98494
  derived and/or modified sequence opt2 from hemagglutinin__InfluenzaA__AHC60731

SEQ ID NO: 102300 - RNA, 1701 nt, Artificial Sequence; identical to SEQ ID NO: 102205
  derived and/or modified sequence opt2 from hemagglutinin__InfluenzaA__AHC60743

SEQ ID NO: 102301 - RNA, 1701 nt, Artificial Sequence; identical to SEQ ID NO: 94923
  derived and/or modified sequence opt2 from hemagglutinin__InfluenzaA__AHC60767

SEQ ID NO: 102302 - RNA, 1701 nt, Artificial Sequence
  derived and/or modified sequence opt2 from hemagglutinin__InfluenzaA__AHC60779
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgagcgcuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccgccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102303 - RNA, 1701 nt, Artificial Sequence; identical to SEQ ID NO: 98494
  derived and/or modified sequence opt2 from hemagglutinin__InfluenzaA__AHC60791

SEQ ID NO: 102304 - RNA, 1701 nt, Artificial Sequence; identical to SEQ ID NO: 102163
  derived and/or modified sequence opt2 from hemagglutinin__InfluenzaA__AHC60803

SEQ ID NO: 102305 - RNA, 1701 nt, Artificial Sequence; identical to SEQ ID NO: 98367
  derived and/or modified sequence opt2 from hemagglutinin__InfluenzaA__AHC60815

SEQ ID NO: 102306 - RNA, 1701 nt, Artificial Sequence
  derived and/or modified sequence opt2 from hemagglutinin__InfluenzaA__AHC60827
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccgacgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcggcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102307 - RNA, 1701 nt, Artificial Sequence; identical to SEQ ID NO: 102141
  derived and/or modified sequence opt2 from hemagglutinin__InfluenzaA__AHC60839

SEQ ID NO: 102308 - RNA, 1701 nt, Artificial Sequence; identical to SEQ ID NO: 98494
  derived and/or modified sequence opt2 from hemagglutinin__InfluenzaA__AHC60851

SEQ ID NO: 102309 - RNA, 1701 nt, Artificial Sequence
  derived and/or modified sequence opt2 from hemagglutinin__InfluenzaA__AHC60863
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccgccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaggccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102310 - RNA, 1701 nt, Artificial Sequence; identical to SEQ ID NO: 98494
  derived and/or modified sequence opt2 from hemagglutinin__InfluenzaA__AHC60875

SEQ ID NO: 102311 - RNA, 1701 nt, Artificial Sequence; identical to SEQ ID NO: 98494
  derived and/or modified sequence opt2 from hemagglutinin__InfluenzaA__AHC60887

SEQ ID NO: 102312 - RNA, 1701 nt, Artificial Sequence; identical to SEQ ID NO: 94923
  derived and/or modified sequence opt2 from hemagglutinin__InfluenzaA__AHC60899

SEQ ID NO: 102313 - RNA, 1701 nt, Artificial Sequence; identical to SEQ ID NO: 99294
  derived and/or modified sequence opt2 from hemagglutinin__InfluenzaA__AHC60911

SEQ ID NO: 102314 - RNA, 1701 nt, Artificial Sequence; identical to SEQ ID NO: 102130
  derived and/or modified sequence opt2 from hemagglutinin__InfluenzaA__AHC60923

SEQ ID NO: 102315 - RNA, 1701 nt, Artificial Sequence; identical to SEQ ID NO: 99294
  derived and/or modified sequence opt2 from hemagglutinin__InfluenzaA__AHC60935

SEQ ID NO: 102316 - RNA, 1701 nt, Artificial Sequence; identical to SEQ ID NO: 98494
  derived and/or modified sequence opt2 from hemagglutinin__InfluenzaA__AHC60947

SEQ ID NO: 102317 - RNA, 1701 nt, Artificial Sequence; identical to SEQ ID NO: 99294
  derived and/or modified sequence opt2 from hemagglutinin__InfluenzaA__AHC60959

SEQ ID NO: 102318 - RNA, 1701 nt, Artificial Sequence; identical to SEQ ID NO: 98367
  derived and/or modified sequence opt2 from hemagglutinin__InfluenzaA__AHC60971

SEQ ID NO: 102319 - RNA, 1701 nt, Artificial Sequence; identical to SEQ ID NO: 99294
  derived and/or modified sequence opt2 from hemagglutinin__InfluenzaA__AHC60983

SEQ ID NO: 102320 - RNA, 1701 nt, Artificial Sequence; identical to SEQ ID NO: 98494
  derived and/or modified sequence opt2 from hemagglutinin__InfluenzaA__AHC61007

SEQ ID NO: 102321 - RNA, 1701 nt, Artificial Sequence; identical to SEQ ID NO: 98367
  derived and/or modified sequence opt2 from hemagglutinin__InfluenzaA__AHC61019

SEQ ID NO: 102322 - RNA, 1701 nt, Artificial Sequence
  derived and/or modified sequence opt2 from hemagglutinin__InfluenzaA__AHC61031
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccgccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 102323 - RNA, 1701 nt, Artificial Sequence; identical to SEQ ID NO: 99294
  derived and/or modified sequence opt2 from hemagglutinin__InfluenzaA__AHC61043

SEQ ID NO: 102324 - RNA, 1701 nt, Artificial Sequence
  derived and/or modified sequence opt2 from hemagglutinin__InfluenzaA__AHC61055
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccgccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccagaaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102325 - RNA, 1701 nt, Artificial Sequence; identical to SEQ ID NO: 102191
  derived and/or modified sequence opt2 from hemagglutinin__InfluenzaA__AHC61067

SEQ ID NO: 102326 - RNA, 1701 nt, Artificial Sequence; identical to SEQ ID NO: 100586
  derived and/or modified sequence opt2 from hemagglutinin__InfluenzaA__AHC61079

SEQ ID NO: 102327 - RNA, 1701 nt, Artificial Sequence; identical to SEQ ID NO: 98494
  derived and/or modified sequence opt2 from hemagglutinin__InfluenzaA__AHC61103

SEQ ID NO: 102328 - RNA, 1701 nt, Artificial Sequence; identical to SEQ ID NO: 98494
  derived and/or modified sequence opt2 from hemagglutinin__InfluenzaA__AHC61115

SEQ ID NO: 102329 - RNA, 1701 nt, Artificial Sequence; identical to SEQ ID NO: 99294
  derived and/or modified sequence opt2 from hemagglutinin__InfluenzaA__AHC61127

SEQ ID NO: 102330 - RNA, 1701 nt, Artificial Sequence
  derived and/or modified sequence opt2 from hemagglutinin__InfluenzaA__AHC61139
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccacccagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102331 - RNA, 1701 nt, Artificial Sequence; identical to SEQ ID NO: 98494
  derived and/or modified sequence opt2 from hemagglutinin__InfluenzaA__AHC61151

SEQ ID NO: 102332 - RNA, 1701 nt, Artificial Sequence
  derived and/or modified sequence opt2 from hemagglutinin__InfluenzaA__AHC61163
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaagaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucguccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102333 - RNA, 1701 nt, Artificial Sequence; identical to SEQ ID NO: 99294
  derived and/or modified sequence opt2 from hemagglutinin__InfluenzaA__AHC61175

SEQ ID NO: 102334 - RNA, 1701 nt, Artificial Sequence; identical to SEQ ID NO: 98494
  derived and/or modified sequence opt2 from hemagglutinin__InfluenzaA__AHC61187

SEQ ID NO: 102335 - RNA, 1701 nt, Artificial Sequence; identical to SEQ ID NO: 98367
  derived and/or modified sequence opt2 from hemagglutinin__InfluenzaA__AHC61199

SEQ ID NO: 102336 - RNA, 1701 nt, Artificial Sequence; identical to SEQ ID NO: 102130
  derived and/or modified sequence opt2 from hemagglutinin__InfluenzaA__AHC61211

SEQ ID NO: 102337 - RNA, 1701 nt, Artificial Sequence; identical to SEQ ID NO: 98367
  derived and/or modified sequence opt2 from hemagglutinin__InfluenzaA__AHC61223

SEQ ID NO: 102338 - RNA, 1701 nt, Artificial Sequence; identical to SEQ ID NO: 98494
  derived and/or modified sequence opt2 from hemagglutinin__InfluenzaA__AHC61235

SEQ ID NO: 102339 - RNA, 1701 nt, Artificial Sequence; identical to SEQ ID NO: 99294
  derived and/or modified sequence opt2 from hemagglutinin__InfluenzaA__AHC61247

SEQ ID NO: 102340 - RNA, 1701 nt, Artificial Sequence; identical to SEQ ID NO: 99294
  derived and/or modified sequence opt2 from hemagglutinin__InfluenzaA__AHC61259

SEQ ID NO: 102341 - RNA, 1701 nt, Artificial Sequence; identical to SEQ ID NO: 98494
  derived and/or modified sequence opt2 from hemagglutinin__InfluenzaA__AHC61271

SEQ ID NO: 102342 - RNA, 1701 nt, Artificial Sequence; identical to SEQ ID NO: 98367
  derived and/or modified sequence opt2 from hemagglutinin__InfluenzaA__AHC61283

SEQ ID NO: 102343 - RNA, 1701 nt, Artificial Sequence; identical to SEQ ID NO: 100586
  derived and/or modified sequence opt2 from hemagglutinin__InfluenzaA__AHC61295

SEQ ID NO: 102344 - RNA, 1701 nt, Artificial Sequence; identical to SEQ ID NO: 102198
  derived and/or modified sequence opt2 from hemagglutinin__InfluenzaA__AHC61307

SEQ ID NO: 102345 - RNA, 1701 nt, Artificial Sequence; identical to SEQ ID NO: 98494
  derived and/or modified sequence opt2 from hemagglutinin__InfluenzaA__AHC61319

SEQ ID NO: 102346 - RNA, 1701 nt, Artificial Sequence; identical to SEQ ID NO: 102130
  derived and/or modified sequence opt2 from hemagglutinin__InfluenzaA__AHC61331

SEQ ID NO: 102347 - RNA, 1701 nt, Artificial Sequence
  derived and/or modified sequence opt2 from hemagglutinin__InfluenzaA__AHC61343
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcggcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102348 - RNA, 1701 nt, Artificial Sequence; identical to SEQ ID NO: 98367
  derived and/or modified sequence opt2 from hemagglutinin__InfluenzaA__AHC61355

SEQ ID NO: 102349 - RNA, 1701 nt, Artificial Sequence; identical to SEQ ID NO: 98367
  derived and/or modified sequence opt2 from hemagglutinin__InfluenzaA__AHC61367

SEQ ID NO: 102350 - RNA, 1701 nt, Artificial Sequence; identical to SEQ ID NO: 98494
  derived and/or modified sequence opt2 from hemagglutinin__InfluenzaA__AHC61379

SEQ ID NO: 102351 - RNA, 1701 nt, Artificial Sequence; identical to SEQ ID NO: 98367
  derived and/or modified sequence opt2 from hemagglutinin__InfluenzaA__AHC61391

SEQ ID NO: 102352 - RNA, 1701 nt, Artificial Sequence
  derived and/or modified sequence opt2 from hemagglutinin__InfluenzaA__AHC61403
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcucccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102353 - RNA, 1701 nt, Artificial Sequence; identical to SEQ ID NO: 98494
  derived and/or modified sequence opt2 from hemagglutinin__InfluenzaA__AHC61415

SEQ ID NO: 102354 - RNA, 1701 nt, Artificial Sequence
  derived and/or modified sequence opt2 from hemagglutinin__InfluenzaA__AHC61427
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaacaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccgccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucauccgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102355 - RNA, 1701 nt, Artificial Sequence
  derived and/or modified sequence opt2 from hemagglutinin__InfluenzaA__AHC61439
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccgccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccaccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102356 - RNA, 1701 nt, Artificial Sequence; identical to SEQ ID NO: 98367
  derived and/or modified sequence opt2 from hemagglutinin__InfluenzaA__AHC61451

SEQ ID NO: 102357 - RNA, 1701 nt, Artificial Sequence; identical to SEQ ID NO: 98367
  derived and/or modified sequence opt2 from hemagglutinin__InfluenzaA__AHC61463

SEQ ID NO: 102358 - RNA, 1701 nt, Artificial Sequence; identical to SEQ ID NO: 99294
  derived and/or modified sequence opt2 from hemagglutinin__InfluenzaA__AHC61475

SEQ ID NO: 102359 - RNA, 1701 nt, Artificial Sequence; identical to SEQ ID NO: 98494
  derived and/or modified sequence opt2 from hemagglutinin__InfluenzaA__AHC61487

SEQ ID NO: 102360 - RNA, 1701 nt, Artificial Sequence; identical to SEQ ID NO: 99294
  derived and/or modified sequence opt2 from hemagglutinin__InfluenzaA__AHC61499

SEQ ID NO: 102361 - RNA, 1701 nt, Artificial Sequence; identical to SEQ ID NO: 98367
  derived and/or modified sequence opt2 from hemagglutinin__InfluenzaA__AHC61511

SEQ ID NO: 102362 - RNA, 1701 nt, Artificial Sequence; identical to SEQ ID NO: 100586
  derived and/or modified sequence opt2 from hemagglutinin__InfluenzaA__AHC61523

SEQ ID NO: 102363 - RNA, 1701 nt, Artificial Sequence
  derived and/or modified sequence opt2 from hemagglutinin__InfluenzaA__AHC61535
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaccaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102364 - RNA, 1701 nt, Artificial Sequence; identical to SEQ ID NO: 98367
  derived and/or modified sequence opt2 from hemagglutinin__InfluenzaA__AHC61547

SEQ ID NO: 102365 - RNA, 1701 nt, Artificial Sequence
  derived and/or modified sequence opt2 from hemagglutinin__InfluenzaA__AHC61559
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcgagaucugcgacuccccccaccagaucaucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucauccgcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggccacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102366 - RNA, 1701 nt, Artificial Sequence; identical to SEQ ID NO: 100586
  derived and/or modified sequence opt2 from hemagglutinin__InfluenzaA__AHC61571

SEQ ID NO: 102367 - RNA, 1701 nt, Artificial Sequence; identical to SEQ ID NO: 98367
  derived and/or modified sequence opt2 from hemagglutinin__InfluenzaA__AHC61583

SEQ ID NO: 102368 - RNA, 1701 nt, Artificial Sequence; identical to SEQ ID NO: 100586
  derived and/or modified sequence opt2 from hemagglutinin__InfluenzaA__AHC61595

SEQ ID NO: 102369 - RNA, 1701 nt, Artificial Sequence
  derived and/or modified sequence opt2 from hemagglutinin__InfluenzaA__AHC61607
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagcacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102370 - RNA, 1701 nt, Artificial Sequence; identical to SEQ ID NO: 100586
  derived and/or modified sequence opt2 from hemagglutinin__InfluenzaA__AHC61619

SEQ ID NO: 102371 - RNA, 1701 nt, Artificial Sequence
  derived and/or modified sequence opt2 from hemagglutinin__InfluenzaA__AHC61631
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcaccaucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccgccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102372 - RNA, 1701 nt, Artificial Sequence
  derived and/or modified sequence opt2 from hemagglutinin__InfluenzaA__AHC61643
augaagaccaucaucgcccucuccuacguccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccgccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102373 - RNA, 1701 nt, Artificial Sequence
  derived and/or modified sequence opt2 from hemagglutinin__InfluenzaA__AHC61655
augaagaccaucaucgcccucuccuacauccucugccucgucuucacccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaacaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccgccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucauccgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102374 - RNA, 1701 nt, Artificial Sequence
  derived and/or modified sequence opt2 from hemagglutinin__InfluenzaA__AHC61667
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102375 - RNA, 1701 nt, Artificial Sequence; identical to SEQ ID NO: 102130
  derived and/or modified sequence opt2 from hemagglutinin__InfluenzaA__AHC61679

SEQ ID NO: 102376 - RNA, 1701 nt, Artificial Sequence; identical to SEQ ID NO: 100586
  derived and/or modified sequence opt2 from hemagglutinin__InfluenzaA__AHC61691

SEQ ID NO: 102377 - RNA, 1701 nt, Artificial Sequence; identical to SEQ ID NO: 98367
  derived and/or modified sequence opt2 from hemagglutinin__InfluenzaA__AHC61703

SEQ ID NO: 102378 - RNA, 1701 nt, Artificial Sequence; identical to SEQ ID NO: 102163
  derived and/or modified sequence opt2 from hemagglutinin__InfluenzaA__AHC61715

SEQ ID NO: 102379 - RNA, 1701 nt, Artificial Sequence; identical to SEQ ID NO: 99294
  derived and/or modified sequence opt2 from hemagglutinin__InfluenzaA__AHC61727

SEQ ID NO: 102380 - RNA, 1701 nt, Artificial Sequence; identical to SEQ ID NO: 98367
  derived and/or modified sequence opt2 from hemagglutinin__InfluenzaA__AHC61739

SEQ ID NO: 102381 - RNA, 1701 nt, Artificial Sequence
  derived and/or modified sequence opt2 from hemagglutinin__InfluenzaA__AHC61751
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacgucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102382 - RNA, 1701 nt, Artificial Sequence
  derived and/or modified sequence opt2 from hemagglutinin__InfluenzaA__AHC61763
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccgccggccgcaucaccgucuccaccaagcgcucccagcagaccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102383 - RNA, 1701 nt, Artificial Sequence; identical to SEQ ID NO: 98494
  derived and/or modified sequence opt2 from hemagglutinin__InfluenzaA__AHC61775

SEQ ID NO: 102384 - RNA, 1701 nt, Artificial Sequence; identical to SEQ ID NO: 99294
  derived and/or modified sequence opt2 from hemagglutinin__InfluenzaA__AHC61787

SEQ ID NO: 102385 - RNA, 1701 nt, Artificial Sequence; identical to SEQ ID NO: 102130
  derived and/or modified sequence opt2 from hemagglutinin__InfluenzaA__AHC61799

SEQ ID NO: 102386 - RNA, 1701 nt, Artificial Sequence
  derived and/or modified sequence opt2 from hemagglutinin__InfluenzaA__AHC61823
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugaaguccgacgcccccaucgacaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102387 - RNA, 1701 nt, Artificial Sequence; identical to SEQ ID NO: 99294
  derived and/or modified sequence opt2 from hemagglutinin__InfluenzaA__AHC61835

SEQ ID NO: 102388 - RNA, 1701 nt, Artificial Sequence; identical to SEQ ID NO: 98494
  derived and/or modified sequence opt2 from hemagglutinin__InfluenzaA__AHC61847

SEQ ID NO: 102389 - RNA, 1701 nt, Artificial Sequence; identical to SEQ ID NO: 98367
  derived and/or modified sequence opt2 from hemagglutinin__InfluenzaA__AHC61859

SEQ ID NO: 102390 - RNA, 1701 nt, Artificial Sequence; identical to SEQ ID NO: 99294
  derived and/or modified sequence opt2 from hemagglutinin__InfluenzaA__AHC61871

SEQ ID NO: 102391 - RNA, 1701 nt, Artificial Sequence
  derived and/or modified sequence opt2 from hemagglutinin__InfluenzaA__AHC61883
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucgccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102392 - RNA, 1701 nt, Artificial Sequence; identical to SEQ ID NO: 98494
  derived and/or modified sequence opt2 from hemagglutinin__InfluenzaA__AHC61895

SEQ ID NO: 102393 - RNA, 1701 nt, Artificial Sequence; identical to SEQ ID NO: 98494
  derived and/or modified sequence opt2 from hemagglutinin__InfluenzaA__AHC61907

SEQ ID NO: 102394 - RNA, 1701 nt, Artificial Sequence
  derived and/or modified sequence opt2 from hemagglutinin__InfluenzaA__AHC61931
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccgccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaagggcuggauccucuggaucuccuucgccaucuccugcuuccuccucugcgucgcccuccucggcuucaucaugugggccugccagaagggcaacauccgcugcaacaucugcaucuga

SEQ ID NO: 102395 - RNA, 1701 nt, Artificial Sequence; identical to SEQ ID NO: 99294
  derived and/or modified sequence opt2 from hemagglutinin__InfluenzaA__AHC61943

SEQ ID NO: 102396 - RNA, 1701 nt, Artificial Sequence; identical to SEQ ID NO: 100586
  derived and/or modified sequence opt2 from hemagglutinin__InfluenzaA__AHC61955

SEQ ID NO: 102397 - RNA, 1701 nt, Artificial Sequence; identical to SEQ ID NO: 99294
  derived and/or modified sequence opt2 from hemagglutinin__InfluenzaA__AHC61967

SEQ ID NO: 102398 - RNA, 1701 nt, Artificial Sequence; identical to SEQ ID NO: 98367
  derived and/or modified sequence opt2 from hemagglutinin__InfluenzaA__AHC61979

SEQ ID NO: 102399 - RNA, 1701 nt, Artificial Sequence; identical to SEQ ID NO: 98494
  derived and/or modified sequence opt2 from hemagglutinin__InfluenzaA__AHC61991

SEQ ID NO: 102400 - RNA, 1701 nt, Artificial Sequence; identical to SEQ ID NO: 102205
  derived and/or modified sequence opt2 from hemagglutinin__InfluenzaA__AHC62003

SEQ ID NO: 102401 - RNA, 1701 nt, Artificial Sequence; identical to SEQ ID NO: 99294
  derived and/or modified sequence opt2 from hemagglutinin__InfluenzaA__AHC62015

SEQ ID NO: 102402 - RNA, 1701 nt, Artificial Sequence; identical to SEQ ID NO: 100586
  derived and/or modified sequence opt2 from hemagglutinin__InfluenzaA__AHC62027

SEQ ID NO: 102403 - RNA, 1701 nt, Artificial Sequence
  derived and/or modified sequence opt2 from hemagglutinin__InfluenzaA__AHC62039
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcggcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugaaguccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102404 - RNA, 1701 nt, Artificial Sequence
  derived and/or modified sequence opt2 from hemagglutinin__InfluenzaA__AHC62050
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacguccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102405 - RNA, 1701 nt, Artificial Sequence; identical to SEQ ID NO: 100586
  derived and/or modified sequence opt2 from hemagglutinin__InfluenzaA__AHC62062

SEQ ID NO: 102406 - RNA, 1701 nt, Artificial Sequence
  derived and/or modified sequence opt2 from hemagglutinin__InfluenzaA__AHC62074
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcaaccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102407 - RNA, 1701 nt, Artificial Sequence; identical to SEQ ID NO: 98367
  derived and/or modified sequence opt2 from hemagglutinin__InfluenzaA__AHC62086

SEQ ID NO: 102408 - RNA, 1701 nt, Artificial Sequence; identical to SEQ ID NO: 99294
  derived and/or modified sequence opt2 from hemagglutinin__InfluenzaA__AHC62098

SEQ ID NO: 102409 - RNA, 1701 nt, Artificial Sequence; identical to SEQ ID NO: 98367
  derived and/or modified sequence opt2 from hemagglutinin__InfluenzaA__AHC62110

SEQ ID NO: 102410 - RNA, 1701 nt, Artificial Sequence
  derived and/or modified sequence opt2 from hemagglutinin__InfluenzaA__AHC62122
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagaugguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcggcuccaacaacuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccgcaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102411 - RNA, 1701 nt, Artificial Sequence; identical to SEQ ID NO: 98367
  derived and/or modified sequence opt2 from hemagglutinin__InfluenzaA__AHC62134

SEQ ID NO: 102412 - RNA, 1701 nt, Artificial Sequence
  derived and/or modified sequence opt2 from hemagglutinin__InfluenzaA__AHC62146
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuacgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102413 - RNA, 1701 nt, Artificial Sequence; identical to SEQ ID NO: 98494
  derived and/or modified sequence opt2 from hemagglutinin__InfluenzaA__AHC62158

SEQ ID NO: 102414 - RNA, 1701 nt, Artificial Sequence
  derived and/or modified sequence opt2 from hemagglutinin__InfluenzaA__AHC62170
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcggcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102415 - RNA, 1701 nt, Artificial Sequence; identical to SEQ ID NO: 98367
  derived and/or modified sequence opt2 from hemagglutinin__InfluenzaA__AHC62182

SEQ ID NO: 102416 - RNA, 1701 nt, Artificial Sequence; identical to SEQ ID NO: 100586
  derived and/or modified sequence opt2 from hemagglutinin__InfluenzaA__AHC62194

SEQ ID NO: 102417 - RNA, 1701 nt, Artificial Sequence
  derived and/or modified sequence opt2 from hemagglutinin__InfluenzaA__AHC62206
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaucuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102418 - RNA, 1701 nt, Artificial Sequence; identical to SEQ ID NO: 98494
  derived and/or modified sequence opt2 from hemagglutinin__InfluenzaA__AHC62218

SEQ ID NO: 102419 - RNA, 1701 nt, Artificial Sequence
  derived and/or modified sequence opt2 from hemagglutinin__InfluenzaA__AHC62242
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccagaucgaggucaccaacgccaccgagcucguccagaacuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucaucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102420 - RNA, 1701 nt, Artificial Sequence; identical to SEQ ID NO: 102129
  derived and/or modified sequence opt2 from hemagglutinin__InfluenzaA__AHC62254

SEQ ID NO: 102421 - RNA, 1701 nt, Artificial Sequence; identical to SEQ ID NO: 98494
  derived and/or modified sequence opt2 from hemagglutinin__InfluenzaA__AHC62266

SEQ ID NO: 102422 - RNA, 1701 nt, Artificial Sequence; identical to SEQ ID NO: 102293
  derived and/or modified sequence opt2 from hemagglutinin__InfluenzaA__AHC62278

SEQ ID NO: 102423 - RNA, 1701 nt, Artificial Sequence
  derived and/or modified sequence opt2 from hemagglutinin__InfluenzaA__AHC62290
augaagaccaucaucgcccucuccuacauccucugccucaucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102424 - RNA, 1701 nt, Artificial Sequence
  derived and/or modified sequence opt2 from hemagglutinin__InfluenzaA__AHC62302
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccgccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102425 - RNA, 1701 nt, Artificial Sequence
  derived and/or modified sequence opt2 from hemagglutinin__InfluenzaA__AHC62314
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagauccgcggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102426 - RNA, 1701 nt, Artificial Sequence; identical to SEQ ID NO: 102290
  derived and/or modified sequence opt2 from hemagglutinin__InfluenzaA__AHC62326

SEQ ID NO: 102427 - RNA, 1701 nt, Artificial Sequence; identical to SEQ ID NO: 99294
  derived and/or modified sequence opt2 from hemagglutinin__InfluenzaA__AHC62338

SEQ ID NO: 102428 - RNA, 1701 nt, Artificial Sequence; identical to SEQ ID NO: 98367
  derived and/or modified sequence opt2 from hemagglutinin__InfluenzaA__AHC62350

SEQ ID NO: 102429 - RNA, 1701 nt, Artificial Sequence; identical to SEQ ID NO: 99294
  derived and/or modified sequence opt2 from hemagglutinin__InfluenzaA__AHC62362

SEQ ID NO: 102430 - RNA, 1701 nt, Artificial Sequence; identical to SEQ ID NO: 99294
  derived and/or modified sequence opt2 from hemagglutinin__InfluenzaA__AHC62374

SEQ ID NO: 102431 - RNA, 1701 nt, Artificial Sequence; identical to SEQ ID NO: 102293
  derived and/or modified sequence opt2 from hemagglutinin__InfluenzaA__AHC62386

SEQ ID NO: 102432 - RNA, 1701 nt, Artificial Sequence; identical to SEQ ID NO: 98367
  derived and/or modified sequence opt2 from hemagglutinin__InfluenzaA__AHC62398

SEQ ID NO: 102433 - RNA, 1701 nt, Artificial Sequence
  derived and/or modified sequence opt2 from hemagglutinin__InfluenzaA__AHC62410
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucauccgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102434 - RNA, 1701 nt, Artificial Sequence; identical to SEQ ID NO: 102236
  derived and/or modified sequence opt2 from hemagglutinin__InfluenzaA__AHC62422

SEQ ID NO: 102435 - RNA, 1701 nt, Artificial Sequence
  derived and/or modified sequence opt2 from hemagglutinin__InfluenzaA__AHC62434
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccgccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102436 - RNA, 1701 nt, Artificial Sequence; identical to SEQ ID NO: 98367
  derived and/or modified sequence opt2 from hemagglutinin__InfluenzaA__AHC62446

SEQ ID NO: 102437 - RNA, 1701 nt, Artificial Sequence; identical to SEQ ID NO: 98494
  derived and/or modified sequence opt2 from hemagglutinin__InfluenzaA__AHC62458

SEQ ID NO: 102438 - RNA, 1701 nt, Artificial Sequence
  derived and/or modified sequence opt2 from hemagglutinin__InfluenzaA__AHC62470
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacggcaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102439 - RNA, 1701 nt, Artificial Sequence; identical to SEQ ID NO: 102191
  derived and/or modified sequence opt2 from hemagglutinin__InfluenzaA__AHC62482

SEQ ID NO: 102440 - RNA, 1701 nt, Artificial Sequence; identical to SEQ ID NO: 98367
  derived and/or modified sequence opt2 from hemagglutinin__InfluenzaA__AHC62506

SEQ ID NO: 102441 - RNA, 1701 nt, Artificial Sequence; identical to SEQ ID NO: 98494
  derived and/or modified sequence opt2 from hemagglutinin__InfluenzaA__AHC62518

SEQ ID NO: 102442 - RNA, 1701 nt, Artificial Sequence
  derived and/or modified sequence opt2 from hemagglutinin__InfluenzaA__AHC62530
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102443 - RNA, 1701 nt, Artificial Sequence; identical to SEQ ID NO: 102163
  derived and/or modified sequence opt2 from hemagglutinin__InfluenzaA__AHC62542

SEQ ID NO: 102444 - RNA, 1701 nt, Artificial Sequence; identical to SEQ ID NO: 98367
  derived and/or modified sequence opt2 from hemagglutinin__InfluenzaA__AHC62554

SEQ ID NO: 102445 - RNA, 1701 nt, Artificial Sequence
  derived and/or modified sequence opt2 from hemagglutinin__InfluenzaA__AHC62566
augaagaccaucaucgcccucuccuacauccucugccucgucuucgcccagaagcuccccggcaacgacaacuccaccgccacccucugccucggccaccacgccguccccaacggcaccauggucaagaccaucaccaacgaccagaucgaggucaccaacgccaccgagcucguccagaacuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102446 - RNA, 1701 nt, Artificial Sequence; identical to SEQ ID NO: 98367
  derived and/or modified sequence opt2 from hemagglutinin__InfluenzaA__AHC62578

SEQ ID NO: 102447 - RNA, 1701 nt, Artificial Sequence; identical to SEQ ID NO: 98367
  derived and/or modified sequence opt2 from hemagglutinin__InfluenzaA__AHC62590

SEQ ID NO: 102448 - RNA, 1701 nt, Artificial Sequence; identical to SEQ ID NO: 98494
  derived and/or modified sequence opt2 from hemagglutinin__InfluenzaA__AHC62602

SEQ ID NO: 102449 - RNA, 1701 nt, Artificial Sequence
  derived and/or modified sequence opt2 from hemagglutinin__InfluenzaA__AHC62614
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagaucaucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcggcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102450 - RNA, 1701 nt, Artificial Sequence; identical to SEQ ID NO: 102130
  derived and/or modified sequence opt2 from hemagglutinin__InfluenzaA__AHC62626

SEQ ID NO: 102451 - RNA, 1701 nt, Artificial Sequence; identical to SEQ ID NO: 98494
  derived and/or modified sequence opt2 from hemagglutinin__InfluenzaA__AHC62638

SEQ ID NO: 102452 - RNA, 1701 nt, Artificial Sequence; identical to SEQ ID NO: 102294
  derived and/or modified sequence opt2 from hemagglutinin__InfluenzaA__AHC62650

SEQ ID NO: 102453 - RNA, 1701 nt, Artificial Sequence
  derived and/or modified sequence opt2 from hemagglutinin__InfluenzaA__AHC62662
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccuccugcuaccccuacgacguccccgacuacgccucccuccgcucccucgucgccuccuccggcacccucgaguucaacaacgaguccuucaacuggaccggcgucacccagaacggcaccuccuccgccugcauccgcggcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102454 - RNA, 1701 nt, Artificial Sequence
  derived and/or modified sequence opt2 from hemagglutinin__InfluenzaA__AHC62674
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucaucgccuccuccggcacccucgaguucaacaacgaguccuucaacuggaccggcgucacccagaacggcaccuccuccgccugcauccgcggcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacaccugcaucgaguccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102455 - RNA, 1701 nt, Artificial Sequence; identical to SEQ ID NO: 101572
  derived and/or modified sequence opt2 from hemagglutinin__InfluenzaA__AHE37972

SEQ ID NO: 102456 - RNA, 1701 nt, Artificial Sequence
  derived and/or modified sequence opt2 from hemagglutinin__InfluenzaA__AHE37973
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcaccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaucaacuacuacuggacccucaucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102457 - RNA, 1701 nt, Artificial Sequence
  derived and/or modified sequence opt2 from hemagglutinin__InfluenzaA__AHE37974
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagauguuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccuccaaguacuccaagaaguucaagcccgagaucgccauccgccccaagguccgcgaccaggagggccgcaugaacuacuacuggacccucaucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102458 - RNA, 1701 nt, Artificial Sequence; identical to SEQ ID NO: 101552
  derived and/or modified sequence opt2 from hemagglutinin__InfluenzaA__AHE37975

SEQ ID NO: 102459 - RNA, 1701 nt, Artificial Sequence
  derived and/or modified sequence opt2 from hemagglutinin__InfluenzaA__AHE37976
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccgccgccuccuccugguccuacaucgucgagaccuccuccuccaacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagauccucguccucuggggcauccaccaccccuccaccaccaccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucaucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcggcaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102460 - RNA, 1701 nt, Artificial Sequence; identical to SEQ ID NO: 101552
  derived and/or modified sequence opt2 from hemagglutinin__InfluenzaA__AHE37977

SEQ ID NO: 102461 - RNA, 1701 nt, Artificial Sequence; identical to SEQ ID NO: 101572
  derived and/or modified sequence opt2 from hemagglutinin__InfluenzaA__AHE37978

SEQ ID NO: 102462 - RNA, 1701 nt, Artificial Sequence; identical to SEQ ID NO: 101552
  derived and/or modified sequence opt2 from hemagglutinin__InfluenzaA__AHE37979

SEQ ID NO: 102463 - RNA, 1701 nt, Artificial Sequence
  derived and/or modified sequence opt2 from hemagglutinin__InfluenzaA__AHE37980
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucaccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucaucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102464 - RNA, 1701 nt, Artificial Sequence
  derived and/or modified sequence opt2 from hemagglutinin__InfluenzaA__AHE37981
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagauguuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccuccaaguacuccaagaaguucaagcccgagaucgccauccgccccaagguccgcgaccaggagggccgcaugaacuacuacuggacccucaucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacauccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102465 - RNA, 1701 nt, Artificial Sequence; identical to SEQ ID NO: 101552
  derived and/or modified sequence opt2 from hemagglutinin__InfluenzaA__AHE37982

SEQ ID NO: 102466 - RNA, 1701 nt, Artificial Sequence
  derived and/or modified sequence opt2 from hemagglutinin__InfluenzaA__AHE37983
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccgaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucaucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102467 - RNA, 1701 nt, Artificial Sequence
  derived and/or modified sequence opt2 from hemagglutinin__InfluenzaA__AHE37984
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucaucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102468 - RNA, 1701 nt, Artificial Sequence
  derived and/or modified sequence opt2 from hemagglutinin__InfluenzaA__AHE37985
augaagaccaucaucgcccucuccuacauccucugccucgucuucgcccaggagcuccccggcaacgacgacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugaaguccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102469 - RNA, 1701 nt, Artificial Sequence; identical to SEQ ID NO: 101434
  derived and/or modified sequence opt2 from hemagglutinin__InfluenzaA__AHE37986

SEQ ID NO: 102470 - RNA, 1701 nt, Artificial Sequence; identical to SEQ ID NO: 101370
  derived and/or modified sequence opt2 from hemagglutinin__InfluenzaA__AHE37987

SEQ ID NO: 102471 - RNA, 1701 nt, Artificial Sequence
  derived and/or modified sequence opt2 from hemagglutinin__InfluenzaA__AHE37988
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccagaaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102472 - RNA, 1701 nt, Artificial Sequence; identical to SEQ ID NO: 101506
  derived and/or modified sequence opt2 from hemagglutinin__InfluenzaA__AHE37989

SEQ ID NO: 102473 - RNA, 1701 nt, Artificial Sequence; identical to SEQ ID NO: 101370
  derived and/or modified sequence opt2 from hemagglutinin__InfluenzaA__AHE37990

SEQ ID NO: 102474 - RNA, 1701 nt, Artificial Sequence; identical to SEQ ID NO: 101370
  derived and/or modified sequence opt2 from hemagglutinin__InfluenzaA__AHE37991

SEQ ID NO: 102475 - RNA, 1701 nt, Artificial Sequence
  derived and/or modified sequence opt2 from hemagglutinin__InfluenzaA__AHE37992
augaagaccaucaucgcccucuccuacauccucugccucgucuucgcccaggagcuccccggcaacgacgacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucgacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102476 - RNA, 1701 nt, Artificial Sequence; identical to SEQ ID NO: 101552
  derived and/or modified sequence opt2 from hemagglutinin__InfluenzaA__AHE38023

SEQ ID NO: 102477 - RNA, 1701 nt, Artificial Sequence
  derived and/or modified sequence opt2 from hemagglutinin__InfluenzaA__AHE38024
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccacccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102478 - RNA, 1701 nt, Artificial Sequence
  derived and/or modified sequence opt2 from hemagglutinin__InfluenzaA__AHE38026
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgagaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102479 - RNA, 1701 nt, Artificial Sequence; identical to SEQ ID NO: 101395
  derived and/or modified sequence opt2 from hemagglutinin__InfluenzaA__AHE38027

SEQ ID NO: 102480 - RNA, 1683 nt, Artificial Sequence
  derived and/or modified sequence opt2 from hemagglutinin__InfluenzaA__AHF20558
augaacacccagauccucgucuucgcccucaucgccaucauccccaccaacgccgacaagaucugccucggccaccacgccgucuccaacggcaccaaggucaacacccucaccgagcgcggcgucgaggucgucaacgccaccgagaccgucgagcgcaccaacaucccccgcaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggaggccaugggcuucaccuacuccggcauccgcaccaacggcgccaccuccgccugccgccgcuccggcuccuccuucuacgccgagaugaaguggcuccucuccaacaccgacaacgccgccuucccccagaugaccaaguccuacaagaacacccgcaagucccccgcccucaucgucuggggcauccaccacuccgucuccaccgccgagcagaccaagcucuacggcuccggcaacaagcucgucaccgucggcuccuccaacuaccagcaguccuucguccccucccccggcgcccgcccccaggucaacggccucuccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacuccggcggcaccaucaucuccaaccuccccuuccagaacaucgacucccgcgccgucggcaagugcccccgcuacgucaagcagcgcucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucgaccagaucaccggcaagcucaaccgccucaucgagaagaccaaccagcaguucgagcucaucgacaacgaguucaacgaggucgagaagcagaucggcaacgucaucaacuggacccgcgacuccaucaccgaggucugguccuacaacgccgagcuccucgucgccauggagaaccagcacaccaucgaccucgccgacuccgagauggacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgucaugggccucgucuucaucugcguccagaacggcaacaugcgcugcaccaucggcaucuga

SEQ ID NO: 102481 - RNA, 1683 nt, Artificial Sequence
  derived and/or modified sequence opt2 from hemagglutinin__InfluenzaA__AHF20568
augaacacccagauccucgucuucgcccucaucgccaucauccccaccaacgccgacaagaucugccucggccaccacgccgucuccaacggcaccaaggucaacacccucaccgagcgcggcgucgaggucgucaacgccaccgagaccgucgagcgcaccaacaucccccgcaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggaggccaugggcuucaccuacuccggcauccgcaccaacggcgccaccuccgccugccgccgcuccggcuccuccuucuacgccgagaugaaguggcuccucuccaacaccgacaacgccgccuucccccagaugaccaaguccuacaagaacacccgcaagucccccgcccucaucgucuggggcauccaccacuccgucuccaccgccgagcagaccaagcucuacggcuccggcaacaagcucgucaccgucggcuccuccaacuaccagcaguccuucguccccucccccggcgcccgcccccaggucaacggccucuccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacuccggcggcaccaucauguccaaccuccccuuccagaacaucgacucccgcgccgucggcaagugcccccgcuacgucaagcagcgcucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucgaccagaucaccggcaagcucaaccgccucaucgagaagaccaaccagcaguucgagcucaucgacaacgaguucaacgaggucgagaagcagaucggcaacgucaucaacuggacccgcgacuccaucaccgaggucugguccuacaacgccgagcuccucgucgccauggagaaccagcacaccaucgaccucgccgacuccgagauggacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgucaugggccucgucuucaucugcgucaagaacggcaacaugcgcugcaccaucugcaucuga

SEQ ID NO: 102482 - RNA, 1698 nt, Artificial Sequence; identical to SEQ ID NO: 99305
  derived and/or modified sequence opt2 from hemagglutinin__InfluenzaA__AHG96108

SEQ ID NO: 102483 - RNA, 1698 nt, Artificial Sequence; identical to SEQ ID NO: 99305
  derived and/or modified sequence opt2 from hemagglutinin__InfluenzaA__AHG96120

SEQ ID NO: 102484 - RNA, 1698 nt, Artificial Sequence; identical to SEQ ID NO: 99305
  derived and/or modified sequence opt2 from hemagglutinin__InfluenzaA__AHG96132

SEQ ID NO: 102485 - RNA, 1698 nt, Artificial Sequence
  derived and/or modified sequence opt2 from hemagglutinin__InfluenzaA__AHG96144
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcguccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 102486 - RNA, 1698 nt, Artificial Sequence; identical to SEQ ID NO: 99305
  derived and/or modified sequence opt2 from hemagglutinin__InfluenzaA__AHG96156

SEQ ID NO: 102487 - RNA, 1698 nt, Artificial Sequence; identical to SEQ ID NO: 99305
  derived and/or modified sequence opt2 from hemagglutinin__InfluenzaA__AHG96168

SEQ ID NO: 102488 - RNA, 1698 nt, Artificial Sequence; identical to SEQ ID NO: 99305
  derived and/or modified sequence opt2 from hemagglutinin__InfluenzaA__AHG96180

SEQ ID NO: 102489 - RNA, 1698 nt, Artificial Sequence; identical to SEQ ID NO: 99305
  derived and/or modified sequence opt2 from hemagglutinin__InfluenzaA__AHG96192

SEQ ID NO: 102490 - RNA, 1698 nt, Artificial Sequence; identical to SEQ ID NO: 99305
  derived and/or modified sequence opt2 from hemagglutinin__InfluenzaA__AHG96204

SEQ ID NO: 102491 - RNA, 1698 nt, Artificial Sequence; identical to SEQ ID NO: 99305
  derived and/or modified sequence opt2 from hemagglutinin__InfluenzaA__AHG96216

SEQ ID NO: 102492 - RNA, 1698 nt, Artificial Sequence; identical to SEQ ID NO: 99305
  derived and/or modified sequence opt2 from hemagglutinin__InfluenzaA__AHG96228

SEQ ID NO: 102493 - RNA, 1698 nt, Artificial Sequence; identical to SEQ ID NO: 102485
  derived and/or modified sequence opt2 from hemagglutinin__InfluenzaA__AHG96240

SEQ ID NO: 102494 - RNA, 1698 nt, Artificial Sequence; identical to SEQ ID NO: 99305
  derived and/or modified sequence opt2 from hemagglutinin__InfluenzaA__AHG96252

SEQ ID NO: 102495 - RNA, 1698 nt, Artificial Sequence; identical to SEQ ID NO: 99305
  derived and/or modified sequence opt2 from hemagglutinin__InfluenzaA__AHG96264

SEQ ID NO: 102496 - RNA, 1698 nt, Artificial Sequence; identical to SEQ ID NO: 99305
  derived and/or modified sequence opt2 from hemagglutinin__InfluenzaA__AHG96276

SEQ ID NO: 102497 - RNA, 1698 nt, Artificial Sequence; identical to SEQ ID NO: 99305
  derived and/or modified sequence opt2 from hemagglutinin__InfluenzaA__AHG96288

SEQ ID NO: 102498 - RNA, 1698 nt, Artificial Sequence; identical to SEQ ID NO: 99305
  derived and/or modified sequence opt2 from hemagglutinin__InfluenzaA__AHG96300

SEQ ID NO: 102499 - RNA, 1701 nt, Artificial Sequence
  derived and/or modified sequence opt2 from hemagglutinin__InfluenzaA__AHG96312
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgucccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102500 - RNA, 1701 nt, Artificial Sequence; identical to SEQ ID NO: 101552
  derived and/or modified sequence opt2 from hemagglutinin__InfluenzaA__AHG96313

SEQ ID NO: 102501 - RNA, 1701 nt, Artificial Sequence
  derived and/or modified sequence opt2 from hemagglutinin__InfluenzaA__AHG96314
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguacaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102502 - RNA, 1701 nt, Artificial Sequence; identical to SEQ ID NO: 101552
  derived and/or modified sequence opt2 from hemagglutinin__InfluenzaA__AHG96315

SEQ ID NO: 102503 - RNA, 1701 nt, Artificial Sequence; identical to SEQ ID NO: 101552
  derived and/or modified sequence opt2 from hemagglutinin__InfluenzaA__AHG96316

SEQ ID NO: 102504 - RNA, 1701 nt, Artificial Sequence; identical to SEQ ID NO: 101552
  derived and/or modified sequence opt2 from hemagglutinin__InfluenzaA__AHG96317

SEQ ID NO: 102505 - RNA, 1701 nt, Artificial Sequence; identical to SEQ ID NO: 101552
  derived and/or modified sequence opt2 from hemagglutinin__InfluenzaA__AHG96320

SEQ ID NO: 102506 - RNA, 1701 nt, Artificial Sequence; identical to SEQ ID NO: 101552
  derived and/or modified sequence opt2 from hemagglutinin__InfluenzaA__AHG96321

SEQ ID NO: 102507 - RNA, 1701 nt, Artificial Sequence; identical to SEQ ID NO: 101552
  derived and/or modified sequence opt2 from hemagglutinin__InfluenzaA__AHG96322

SEQ ID NO: 102508 - RNA, 1701 nt, Artificial Sequence; identical to SEQ ID NO: 101552
  derived and/or modified sequence opt2 from hemagglutinin__InfluenzaA__AHG96324

SEQ ID NO: 102509 - RNA, 1701 nt, Artificial Sequence; identical to SEQ ID NO: 101552
  derived and/or modified sequence opt2 from hemagglutinin__InfluenzaA__AHG96325

SEQ ID NO: 102510 - RNA, 1701 nt, Artificial Sequence
  derived and/or modified sequence opt2 from hemagglutinin__InfluenzaA__AHG96326
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaacuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102511 - RNA, 1701 nt, Artificial Sequence; identical to SEQ ID NO: 101552
  derived and/or modified sequence opt2 from hemagglutinin__InfluenzaA__AHG96327

SEQ ID NO: 102512 - RNA, 1701 nt, Artificial Sequence
  derived and/or modified sequence opt2 from hemagglutinin__InfluenzaA__AHG96329
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagauccgcaaccagcucaagaacaacgccaaggagaucggcaacggcugcuucgaguucuaccacaagugcgacaacaccugcauggaguccgucaagaacggcaccuacgaguaccccaaguacuccgaggaggccaagcucaaccgcgagaagaucgacggcgucaagcucgaguccaccaagaucuaccagauccucgccaucuacuccaccgucgccuccucccucguccucgucgucucccucggcgccaucuccuucuggaugugcuccaacggcucccuccagugccgcaucugcaucuga

SEQ ID NO: 102513 - RNA, 1701 nt, Artificial Sequence
  derived and/or modified sequence opt2 from hemagglutinin__InfluenzaA__AHG96330
augaaggccauccucgucguccuccucuacaccuucgccaccgccaccgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcucucccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagauccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102514 - RNA, 1701 nt, Artificial Sequence; identical to SEQ ID NO: 101552
  derived and/or modified sequence opt2 from hemagglutinin__InfluenzaA__AHG96332

SEQ ID NO: 102515 - RNA, 1701 nt, Artificial Sequence
  derived and/or modified sequence opt2 from hemagglutinin__InfluenzaA__AHG96334
augaaggccauccucgucguccuccucuacacccucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102516 - RNA, 1701 nt, Artificial Sequence
  derived and/or modified sequence opt2 from hemagglutinin__InfluenzaA__AHG96335
augaaggccauccucgucguccuccucuacaccuucgagaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcucaagggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102517 - RNA, 1701 nt, Artificial Sequence
  derived and/or modified sequence opt2 from hemagglutinin__InfluenzaA__AHG96336
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccgcgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102518 - RNA, 1701 nt, Artificial Sequence
  derived and/or modified sequence opt2 from hemagglutinin__InfluenzaA__AHG96338
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcucccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102519 - RNA, 1701 nt, Artificial Sequence
  derived and/or modified sequence opt2 from hemagglutinin__InfluenzaA__AHG96339
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagauccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102520 - RNA, 1701 nt, Artificial Sequence; identical to SEQ ID NO: 101552
  derived and/or modified sequence opt2 from hemagglutinin__InfluenzaA__AHG96340

SEQ ID NO: 102521 - RNA, 1701 nt, Artificial Sequence
  derived and/or modified sequence opt2 from hemagglutinin__InfluenzaA__AHG96341
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccuccaaguacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102522 - RNA, 1701 nt, Artificial Sequence
  derived and/or modified sequence opt2 from hemagglutinin__InfluenzaA__AHG96342
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaugugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102523 - RNA, 1701 nt, Artificial Sequence
  derived and/or modified sequence opt2 from hemagglutinin__InfluenzaA__AHG96343
augaaggccauccucgucguccuccucuacaccuucgccaccgccaccgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccaacuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102524 - RNA, 1701 nt, Artificial Sequence; identical to SEQ ID NO: 101552
  derived and/or modified sequence opt2 from hemagglutinin__InfluenzaA__AHG96344

SEQ ID NO: 102525 - RNA, 1701 nt, Artificial Sequence; identical to SEQ ID NO: 102515
  derived and/or modified sequence opt2 from hemagglutinin__InfluenzaA__AHG96345

SEQ ID NO: 102526 - RNA, 1701 nt, Artificial Sequence; identical to SEQ ID NO: 101552
  derived and/or modified sequence opt2 from hemagglutinin__InfluenzaA__AHG96346

SEQ ID NO: 102527 - RNA, 1701 nt, Artificial Sequence; identical to SEQ ID NO: 101552
  derived and/or modified sequence opt2 from hemagglutinin__InfluenzaA__AHG96347

SEQ ID NO: 102528 - RNA, 1701 nt, Artificial Sequence; identical to SEQ ID NO: 101552
  derived and/or modified sequence opt2 from hemagglutinin__InfluenzaA__AHG96348

SEQ ID NO: 102529 - RNA, 1701 nt, Artificial Sequence; identical to SEQ ID NO: 101552
  derived and/or modified sequence opt2 from hemagglutinin__InfluenzaA__AHG96349

SEQ ID NO: 102530 - RNA, 1701 nt, Artificial Sequence; identical to SEQ ID NO: 101552
  derived and/or modified sequence opt2 from hemagglutinin__InfluenzaA__AHG96350

SEQ ID NO: 102531 - RNA, 1701 nt, Artificial Sequence; identical to SEQ ID NO: 101552
  derived and/or modified sequence opt2 from hemagglutinin__InfluenzaA__AHG96351

SEQ ID NO: 102532 - RNA, 1701 nt, Artificial Sequence; identical to SEQ ID NO: 101552
  derived and/or modified sequence opt2 from hemagglutinin__InfluenzaA__AHG96352

SEQ ID NO: 102533 - RNA, 1701 nt, Artificial Sequence
  derived and/or modified sequence opt2 from hemagglutinin__InfluenzaA__AHG96353
augaaggccauccucgucguccuccucuacaccuucgccaccaccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102534 - RNA, 1701 nt, Artificial Sequence; identical to SEQ ID NO: 101552
  derived and/or modified sequence opt2 from hemagglutinin__InfluenzaA__AHG96354

SEQ ID NO: 102535 - RNA, 1701 nt, Artificial Sequence
  derived and/or modified sequence opt2 from hemagglutinin__InfluenzaA__AHG96355
augaaggccauccucgucguccuccucuacacccucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccagcucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102536 - RNA, 1701 nt, Artificial Sequence; identical to SEQ ID NO: 101370
  derived and/or modified sequence opt2 from hemagglutinin__InfluenzaA__AHG96356

SEQ ID NO: 102537 - RNA, 1701 nt, Artificial Sequence
  derived and/or modified sequence opt2 from hemagglutinin__InfluenzaA__AHG96359
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacgacgaguccuucaacuggaccggcgucacccagaacggcaccuccuccuccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccgucaccgacaacgaccagaucuuccucuacgcccaggccuccggccgcaucaccgucuccaccaagcgcucccagcagaccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102538 - RNA, 1701 nt, Artificial Sequence; identical to SEQ ID NO: 102537
  derived and/or modified sequence opt2 from hemagglutinin__InfluenzaA__AHG96371

SEQ ID NO: 102539 - RNA, 1701 nt, Artificial Sequence; identical to SEQ ID NO: 102537
  derived and/or modified sequence opt2 from hemagglutinin__InfluenzaA__AHG96383

SEQ ID NO: 102540 - RNA, 1698 nt, Artificial Sequence; identical to SEQ ID NO: 99305
  derived and/or modified sequence opt2 from hemagglutinin__InfluenzaA__AHG96395

SEQ ID NO: 102541 - RNA, 1701 nt, Artificial Sequence; identical to SEQ ID NO: 102537
  derived and/or modified sequence opt2 from hemagglutinin__InfluenzaA__AHG96407

SEQ ID NO: 102542 - RNA, 1701 nt, Artificial Sequence; identical to SEQ ID NO: 102537
  derived and/or modified sequence opt2 from hemagglutinin__InfluenzaA__AHG96419

SEQ ID NO: 102543 - RNA, 1701 nt, Artificial Sequence; identical to SEQ ID NO: 102537
  derived and/or modified sequence opt2 from hemagglutinin__InfluenzaA__AHG96431

SEQ ID NO: 102544 - RNA, 1701 nt, Artificial Sequence; identical to SEQ ID NO: 102537
  derived and/or modified sequence opt2 from hemagglutinin__InfluenzaA__AHG96443

SEQ ID NO: 102545 - RNA, 1701 nt, Artificial Sequence; identical to SEQ ID NO: 102537
  derived and/or modified sequence opt2 from hemagglutinin__InfluenzaA__AHG96455

SEQ ID NO: 102546 - RNA, 1701 nt, Artificial Sequence; identical to SEQ ID NO: 102537
  derived and/or modified sequence opt2 from hemagglutinin__InfluenzaA__AHG96467

SEQ ID NO: 102547 - RNA, 1701 nt, Artificial Sequence; identical to SEQ ID NO: 102537
  derived and/or modified sequence opt2 from hemagglutinin__InfluenzaA__AHG96479

SEQ ID NO: 102548 - RNA, 1701 nt, Artificial Sequence; identical to SEQ ID NO: 102537
  derived and/or modified sequence opt2 from hemagglutinin__InfluenzaA__AHG96491

SEQ ID NO: 102549 - RNA, 1701 nt, Artificial Sequence; identical to SEQ ID NO: 93868
  derived and/or modified sequence opt2 from hemagglutinin__InfluenzaA__AHG96503

SEQ ID NO: 102550 - RNA, 1698 nt, Artificial Sequence; identical to SEQ ID NO: 99305
  derived and/or modified sequence opt2 from hemagglutinin__InfluenzaA__AHG96515

SEQ ID NO: 102551 - RNA, 1698 nt, Artificial Sequence; identical to SEQ ID NO: 99305
  derived and/or modified sequence opt2 from hemagglutinin__InfluenzaA__AHG96527

SEQ ID NO: 102552 - RNA, 1698 nt, Artificial Sequence; identical to SEQ ID NO: 99305
  derived and/or modified sequence opt2 from hemagglutinin__InfluenzaA__AHG96539

SEQ ID NO: 102553 - RNA, 1698 nt, Artificial Sequence; identical to SEQ ID NO: 99305
  derived and/or modified sequence opt2 from hemagglutinin__InfluenzaA__AHG96551

SEQ ID NO: 102554 - RNA, 1698 nt, Artificial Sequence; identical to SEQ ID NO: 102485
  derived and/or modified sequence opt2 from hemagglutinin__InfluenzaA__AHG96563

SEQ ID NO: 102555 - RNA, 1698 nt, Artificial Sequence; identical to SEQ ID NO: 99305
  derived and/or modified sequence opt2 from hemagglutinin__InfluenzaA__AHG96575

SEQ ID NO: 102556 - RNA, 1698 nt, Artificial Sequence; identical to SEQ ID NO: 99305
  derived and/or modified sequence opt2 from hemagglutinin__InfluenzaA__AHG96587

SEQ ID NO: 102557 - RNA, 1698 nt, Artificial Sequence; identical to SEQ ID NO: 99305
  derived and/or modified sequence opt2 from hemagglutinin__InfluenzaA__AHG96599

SEQ ID NO: 102558 - RNA, 1698 nt, Artificial Sequence; identical to SEQ ID NO: 99305
  derived and/or modified sequence opt2 from hemagglutinin__InfluenzaA__AHG96611

SEQ ID NO: 102559 - RNA, 1698 nt, Artificial Sequence; identical to SEQ ID NO: 99305
  derived and/or modified sequence opt2 from hemagglutinin__InfluenzaA__AHG96623

SEQ ID NO: 102560 - RNA, 1698 nt, Artificial Sequence; identical to SEQ ID NO: 99305
  derived and/or modified sequence opt2 from hemagglutinin__InfluenzaA__AHG96635

SEQ ID NO: 102561 - RNA, 1698 nt, Artificial Sequence; identical to SEQ ID NO: 99305
  derived and/or modified sequence opt2 from hemagglutinin__InfluenzaA__AHG96647

SEQ ID NO: 102562 - RNA, 1698 nt, Artificial Sequence; identical to SEQ ID NO: 99305
  derived and/or modified sequence opt2 from hemagglutinin__InfluenzaA__AHG96659

SEQ ID NO: 102563 - RNA, 1698 nt, Artificial Sequence; identical to SEQ ID NO: 99305
  derived and/or modified sequence opt2 from hemagglutinin__InfluenzaA__AHG96671

SEQ ID NO: 102564 - RNA, 1698 nt, Artificial Sequence; identical to SEQ ID NO: 99305
  derived and/or modified sequence opt2 from hemagglutinin__InfluenzaA__AHG96683

SEQ ID NO: 102565 - RNA, 1701 nt, Artificial Sequence; identical to SEQ ID NO: 102537
  derived and/or modified sequence opt2 from hemagglutinin__InfluenzaA__AHG96695

SEQ ID NO: 102566 - RNA, 1701 nt, Artificial Sequence; identical to SEQ ID NO: 102537
  derived and/or modified sequence opt2 from hemagglutinin__InfluenzaA__AHG96707

SEQ ID NO: 102567 - RNA, 1701 nt, Artificial Sequence; identical to SEQ ID NO: 102537
  derived and/or modified sequence opt2 from hemagglutinin__InfluenzaA__AHG96719

SEQ ID NO: 102568 - RNA, 1701 nt, Artificial Sequence; identical to SEQ ID NO: 102537
  derived and/or modified sequence opt2 from hemagglutinin__InfluenzaA__AHG96731

SEQ ID NO: 102569 - RNA, 1701 nt, Artificial Sequence; identical to SEQ ID NO: 102537
  derived and/or modified sequence opt2 from hemagglutinin__InfluenzaA__AHG96743

SEQ ID NO: 102570 - RNA, 1701 nt, Artificial Sequence; identical to SEQ ID NO: 102537
  derived and/or modified sequence opt2 from hemagglutinin__InfluenzaA__AHG96755

SEQ ID NO: 102571 - RNA, 1701 nt, Artificial Sequence; identical to SEQ ID NO: 102537
  derived and/or modified sequence opt2 from hemagglutinin__InfluenzaA__AHG96767

SEQ ID NO: 102572 - RNA, 1701 nt, Artificial Sequence; identical to SEQ ID NO: 102537
  derived and/or modified sequence opt2 from hemagglutinin__InfluenzaA__AHG96779

SEQ ID NO: 102573 - RNA, 1701 nt, Artificial Sequence
  derived and/or modified sequence opt2 from hemagglutinin__InfluenzaA__AHG96791
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacgacgaguccuucaacuggaccggcgucacccagaacggcaccuccuccuccugcaagcgccgcuccaacaacuccuucuucucccgccucaacuggcucacccagcucaaguucaaguaccccgcccucaacgucaccaugcccaacaacgagaaguucgacaagcucuacaucuggggcguccaccaccccgucaccgacaacgaccagaucuuccucuacgcccaggccuccggccgcaucaccgucuccaccaagcgcucccagcagaccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagcgccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102574 - RNA, 1701 nt, Artificial Sequence; identical to SEQ ID NO: 102537
  derived and/or modified sequence opt2 from hemagglutinin__InfluenzaA__AHG96803

SEQ ID NO: 102575 - RNA, 1701 nt, Artificial Sequence; identical to SEQ ID NO: 102537
  derived and/or modified sequence opt2 from hemagglutinin__InfluenzaA__AHG96815

SEQ ID NO: 102576 - RNA, 1701 nt, Artificial Sequence; identical to SEQ ID NO: 102537
  derived and/or modified sequence opt2 from hemagglutinin__InfluenzaA__AHG96827

SEQ ID NO: 102577 - RNA, 1701 nt, Artificial Sequence; identical to SEQ ID NO: 102537
  derived and/or modified sequence opt2 from hemagglutinin__InfluenzaA__AHG96839

SEQ ID NO: 102578 - RNA, 1701 nt, Artificial Sequence; identical to SEQ ID NO: 102537
  derived and/or modified sequence opt2 from hemagglutinin__InfluenzaA__AHG96851

SEQ ID NO: 102579 - RNA, 1701 nt, Artificial Sequence; identical to SEQ ID NO: 102537
  derived and/or modified sequence opt2 from hemagglutinin__InfluenzaA__AHG96863

SEQ ID NO: 102580 - RNA, 1701 nt, Artificial Sequence; identical to SEQ ID NO: 102537
  derived and/or modified sequence opt2 from hemagglutinin__InfluenzaA__AHG96875

SEQ ID NO: 102581 - RNA, 1701 nt, Artificial Sequence; identical to SEQ ID NO: 102537
  derived and/or modified sequence opt2 from hemagglutinin__InfluenzaA__AHG96887

SEQ ID NO: 102582 - RNA, 1701 nt, Artificial Sequence; identical to SEQ ID NO: 102537
  derived and/or modified sequence opt2 from hemagglutinin__InfluenzaA__AHG96899

SEQ ID NO: 102583 - RNA, 1701 nt, Artificial Sequence; identical to SEQ ID NO: 102537
  derived and/or modified sequence opt2 from hemagglutinin__InfluenzaA__AHG96911

SEQ ID NO: 102584 - RNA, 1701 nt, Artificial Sequence; identical to SEQ ID NO: 102537
  derived and/or modified sequence opt2 from hemagglutinin__InfluenzaA__AHG96923

SEQ ID NO: 102585 - RNA, 1701 nt, Artificial Sequence; identical to SEQ ID NO: 102537
  derived and/or modified sequence opt2 from hemagglutinin__InfluenzaA__AHG96935

SEQ ID NO: 102586 - RNA, 1701 nt, Artificial Sequence; identical to SEQ ID NO: 102537
  derived and/or modified sequence opt2 from hemagglutinin__InfluenzaA__AHG96947

SEQ ID NO: 102587 - RNA, 1701 nt, Artificial Sequence; identical to SEQ ID NO: 102537
  derived and/or modified sequence opt2 from hemagglutinin__InfluenzaA__AHG96959

SEQ ID NO: 102588 - RNA, 1701 nt, Artificial Sequence; identical to SEQ ID NO: 102537
  derived and/or modified sequence opt2 from hemagglutinin__InfluenzaA__AHG96971

SEQ ID NO: 102589 - RNA, 1701 nt, Artificial Sequence; identical to SEQ ID NO: 102537
  derived and/or modified sequence opt2 from hemagglutinin__InfluenzaA__AHG96983

SEQ ID NO: 102590 - RNA, 1701 nt, Artificial Sequence; identical to SEQ ID NO: 102537
  derived and/or modified sequence opt2 from hemagglutinin__InfluenzaA__AHG96995

SEQ ID NO: 102591 - RNA, 1701 nt, Artificial Sequence; identical to SEQ ID NO: 102537
  derived and/or modified sequence opt2 from hemagglutinin__InfluenzaA__AHG97007

SEQ ID NO: 102592 - RNA, 1701 nt, Artificial Sequence; identical to SEQ ID NO: 102537
  derived and/or modified sequence opt2 from hemagglutinin__InfluenzaA__AHG97019

SEQ ID NO: 102593 - RNA, 1701 nt, Artificial Sequence; identical to SEQ ID NO: 102537
  derived and/or modified sequence opt2 from hemagglutinin__InfluenzaA__AHG97031

SEQ ID NO: 102594 - RNA, 1701 nt, Artificial Sequence; identical to SEQ ID NO: 102537
  derived and/or modified sequence opt2 from hemagglutinin__InfluenzaA__AHG97043

SEQ ID NO: 102595 - RNA, 1701 nt, Artificial Sequence
  derived and/or modified sequence opt2 from hemagglutinin__InfluenzaA__AHH00866
augaagaccaucaucgcccucuccuacauccucugccucgccuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucgagaaccgcuaccccgcccucaacgucaccaugcccaacaacgacaaguucgacaagcucuacaucuggggcguccaccaccccuccaccgacuccgaccagaucuccgucuacgcccaggccuccggccgcgucaccgucuccaccaagcgcucccagcagaccgucauccccaacaucggcucccgccccuggguccgcggcaucuccucccgcaucuccaucuacuggaccaucgucaaccccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaacaagcucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 102596 - RNA, 1701 nt, Artificial Sequence
  derived and/or modified sequence opt2 from hemagglutinin__InfluenzaA__AHH00870
augaagaccaucaucgcccucuccuacauccucugccucgccuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccagauccucgacggcgagaacugcacccucaucgacgcccuccucggcgacccccacugcgacggcuuccagaacaaggagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucgcccagaacggcaccuccuccgccugcaagcgccgcuccaucaaguccuucuucucccgccucaacuggcuccaccagcucgagaaccgcuaccccgcccucaacgucaccaugcccaacaacgacaaguucgacaagcucuacaucuggggcguccaccaccccuccaccgacuccgaccagaucuccgucuacgcccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggcaccggccaggccgccgaccucaaguccacccaggccgccaucaaccagaucaacggcaagcucaacaagcucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 102597 - RNA, 1701 nt, Artificial Sequence
  derived and/or modified sequence opt2 from hemagglutinin__InfluenzaA__AHJ57430
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugccgccuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucucccccaagaccuccuccuggcccaaccacgacuccaacaagggcguccgcgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcggccaggagggccgcaugaacuacuacuggacccucgucgagcccggcgacaagaucaccuucgaggccaccggcaaccucgucgucccccgcuacgccuucgccauggagcgcaacgccgccuccggcaucaucaucuccgacacccccguccacgacugcaacaccaccugccagacccccaagggcgccgucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcaacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102598 - RNA, 1701 nt, Artificial Sequence
  derived and/or modified sequence opt2 from hemagglutinin__InfluenzaA__AHJ57431
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcguccgcgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102599 - RNA, 1701 nt, Artificial Sequence
  derived and/or modified sequence opt2 from hemagglutinin__InfluenzaA__AHJ57432
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagccccagaucgccauccgccccaagguccgcgaccaggagggccgcaugaacuacuacuggacccucgucgagcccggcgacaagaucaccuucgaggccaccggcaaccucgucgucccccgcuacgccuucgcccucgagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgagggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102600 - RNA, 1701 nt, Artificial Sequence
  derived and/or modified sequence opt2 from hemagglutinin__InfluenzaA__AHJ57433
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaaggagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucaucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102601 - RNA, 1701 nt, Artificial Sequence
  derived and/or modified sequence opt2 from hemagglutinin__InfluenzaA__AHJ57434
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacccccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaaggagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102602 - RNA, 1701 nt, Artificial Sequence
  derived and/or modified sequence opt2 from hemagglutinin__InfluenzaA__AHJ57435
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaaccgcggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102603 - RNA, 1701 nt, Artificial Sequence
  derived and/or modified sequence opt2 from hemagglutinin__InfluenzaA__AHJ57436
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccauccccaacaacgagcaguucgacaagcucuacaucuggggcguccaccaccccggcaccgacaaggaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagcucaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102604 - RNA, 1701 nt, Artificial Sequence
  derived and/or modified sequence opt2 from hemagglutinin__InfluenzaA__AHJ57437
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcucaaggagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102605 - RNA, 1701 nt, Artificial Sequence
  derived and/or modified sequence opt2 from hemagglutinin__InfluenzaA__AHJ57438
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaaguggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgacugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaccggcuccauccgcaacggcaccuacgaccacgacgucuaccgcgacgaggcccucaacaaccgcuuccagaucaagggcgucgaggucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102606 - RNA, 1701 nt, Artificial Sequence
  derived and/or modified sequence opt2 from hemagglutinin__InfluenzaA__AHJ57651
augaucgccuucaucgucaucgccauccucgccgccaccggcaaguccgacaagaucugcaucggcuaccacgccaacaacuccaccaccaaggucgacaccauccucgagaagaacgucaccgucacccacuccgucgagcuccucgagaaccagaaggaggagcgcuucugcaagaucuccaacaaggccccccucgaccuccgcgacugcacccucgagggcuggauccucggcaacccccgcugcggcauccuccucgccgaccaguccugguccuacaucgucgagcgccccaacgcccgcaacggcaucugcuaccccggcacccucaacgaggucgaggagcucaaggcccucaucggcuccggcgagcgcgucgagcgcuucgagauguuccccaaguccaccugggccggcgucgacaccgacuccggcgucuccuccgccugcccccucggcaacggccccuccuucuaccgcaaccuccucuggaucaucaagcucaaguccuccgaguaccccgucauccgcggcaccuucaacaacaccggcgacaaguccauccucuacuucuggggcguccaccacccccccgucaccaccgagcaggaggcccucuacggcuccggcgaccgcuacguccgcaugggcaccgaguccaugaacuucgcccgcucccccgagaucgccgcccgccccgccgucaacggccagcgcggccgcaucgacuacuucugguccauccucaagcccggcgagacccucaacgucgaguccaacggcaaccucaucgcccccugguacgccuaccgcuucgucaacaaggacuccaagggcgccaucuuccgcuccacccuccccaucgagaacugcgacgccaccugccagaccaccgagggcgucauccgcaccaacaagaccuuccagaacgucuccccccucuggaucggcgagugccccaaguacgucaaguccaagucccuccgccucgccaccggccuccgcaacgucccccagaucgagacccgcggccucuucggcgccaucgccggcuucaucgagggcggcuggaccggcaugaucgacggcugguacggcuaccaccacgagaacucccagggcuccggcuacgccgccgaccgcgaguccacccagaaggccaucgacggcaucaccaacaaggucaacuccaucaucgacaagaugaacacccaguucgaggccgucggccacgaguucuccaaccucgagcgccgcaucgacaaccucaacaagcgcauggaggacggcuuccucgacgucuggaccuacaacgccgagcuccucguccuccucgagaacgagcgcacccucgacaugcacgacgccaacgucaagauccucuacgagaagguccgcucccagcuccgcgacaacgccaaggaccucggcaacggcugcuucgaguucuggcacaagugcgacaacgagugcaucgaguccgucaagaacggcaccuacaacuaccccaaguaccaguccgagucccgccucaaccgccagaccaucgaguccgucaagcucgagaaccucggcgucuaccagauccucgccaucuacuccaccgucuccuccucccucguccucgucggccucauccucgccaugggccucuggaugugcuccaacggcuccaugcagugccgcaucugcaucuga

SEQ ID NO: 102607 - RNA, 1701 nt, Artificial Sequence
  derived and/or modified sequence opt2 from hemagglutinin__InfluenzaA__AHJ57663
augaucgccuucaucgucaucgccacccucgucgccaccggcaaguccgacaagaucugcaucggcuaccacgccaacaacuccaccaccaaggucgacaccauccucgagaagaacgucaccgucacccacuccgucgagcuccucgagaaccagaaggaggagcgcuucugcaagaucuccaacaaggccccccucgaccuccgcgacugcacccucgagggcuggauccucggcaacccccgcugcggcauccuccucgccgaccaguccugguccuacaucgucgagcgccccaacgcccgcaacggcaucugcuaccccggcacccucaacgaggccgaggagcucaaggcccucaucggcuccggcgagcgcgucgagcgcuucgagauguuccccaaguccaccuggaccggcgucgacaccgaguccggcgucuccuccgccugcccccucggcaacggccccuccuucuaccgcaaccuccucuggaucaucaagcucaaguccuccgaguaccccgucauccgcggcaccuucaacaacaccggcgacaaguccauccucuacuucuggggcguccaccacccccccgucaccaccgagcagaacgcccucuacggcuccggcgaccgcuacguccgcaugggcaccgaguccaugaacuucgcccgcucccccgagaucgccgcccgccccgccgucaacggccagcgcggccgcaucgacuacuucugguccauccucaagcccggcgagacccucaacgucgaguccaacggcaaccucaucgcccccugguacgccuaccgcuucgucaacaaggacuccaagggcgccaucuuccgcuccaaccuccccaucgagaacugcgacgccaccugccagaccaccgagggcgucauccgcaccaacaagaccuuccagaacgucuccccccucuggaucggcgagugccccaaguacgucaaguccaagucccuccgccucgccaccggccuccgcaacgucccccagaucgagacccgcggccucuucggcgccaucgccggcuucaucgagggcggcuggaccggcaugaucgacggcugguacggcuaccaccacgagaacucccagggcuccggcuacgccgccgacaaggaguccacccagaaggccaucgacggcaucaccaacaaggucaacuccaucaucgacaagaugaacacccaguucgaggccgucggccacgaguucuccaaccucgagcgccgcaucgacaaccucaacaagcgcauggaggacggcuuccucgacgucuggaccuacaacgccgagcuccucguccuccucgagaacgagcgcacccucgaccuccacgacgccaacgucaagaaccuccacgagcgcgucaagucccagcuccgcgacaacgccaacgaccucggcaacggcugcuucgaguucuggcacaagugcgacaacgagugcauggaguccgucaagaacggcaccuacaacuaccccaaguaccaggccgagucccgccucaacaagcagaagaucgaguccgucaagcucgaggaguucggcgucuaccagauccucgccaucuacuccaccgucuccuccucccucguccucgucggccucaucauggccaugggccucuggaugugccccaacggcuccaugcagugccgcaucugcaucuga

SEQ ID NO: 102608 - RNA, 1701 nt, Artificial Sequence
  derived and/or modified sequence opt2 from hemagglutinin__InfluenzaA__AHJ57674
augaucgccuucaucgucaucgccauccucgucaccaccggcaaguccgacaagaucugcaucggcuaccacgccaacaacuccaccaccaaggucgacaccauccucgagaagaacgucaccgucacccacuccgucgagcuccucgagaaccagaaggaggagcgcuucugcaagaucuccaacaaggccccccucgaccuccgcgacugcacccucgagggcuggauccucggcaacccccgcugcggcauccuccucgccgaccaguccugguccuacaucgucgagcgccccaacgcccgcaacggcaucugcuaccccggcacccucaacgaggucgaggagcucaaggcccucaucggcuccggcgagcgcgucgagcgcuucgagauguuccccaaguccaccugggccggcgucgacaccaacuccggcgucuccuccgccugcccccucggcgagggccccuccuucuaccgcaaccuccucuggaucaucaagcacaccaccuccggcuaccccgucaucaagggcaccuaccgcaacaccggcgacaaguccguccucuacuucuggggcguccaccacccccccgacaccaccgagcagaacguccucuacggcuccggcaaccgcuacguccgcaugggcaccgaguccaugaacuucgcccgcucccccgagaucgccgcccgccccgccgucaacggccagcgcggccgcaucgacuacuucugguccauccucaagcccggcgagacccucaacgucgaguccaacggcaaccucaucgcccccugguacgccuaccgcuucgucaacaaggacuccaagggcgccaucuuccgcuccaaccuccccaucgagaacugcgacgccaccugccagaccaccgagggcgucauccgcaccaacaagaccuuccagaacgucuccccccucuggaucggcgagugccccaaguacgucaaguccaagucccuccgccucgccaccggccuccgcaacgucccccagaucgagacccgcggccucuucggcgccaucgccggcuucaucgagggcggcuggaccggcaugaucgacggcugguacggcuaccaccacgagaacucccagggcuccggcuacgccgccgaccgcgaguccacccagaaggccaucgacggcaucaccaacaaggucaacuccaucaucgacaagaugaacacccaguucgaggccgucggccacgaguucuccaaccucgagcgccgcaucgacaaccucaacaagcgcauggaggacggcuuccucgacgucuggaccuacaacgccgagcuccucguccuccucgagaacgagcgcacccucgaccuccacgacgccaacgucaagaaccuccacgagcgcguccgcucccagcuccgcgacaacgccaacgaccucggcaacggcugcuucgaguucuggcacaagugcgacaacgagugcauggaguccgucaagaacggcaccuacaacuaccccaaguaccaggccgagucccgccucaaccgccagaagaucgaguccgucaagcucgaggaguucggcgucuaccagauccucgccaucuacuccaccgucuccuccucccucguccucgucggccucaucauggccaugggccucuggaugugcuccaacggcuccaugcagugccgcaucugcaucuga

SEQ ID NO: 102609 - RNA, 1701 nt, Artificial Sequence
  derived and/or modified sequence opt2 from hemagglutinin__InfluenzaA__AHJ57686
augaucgccuucaucgucaucgccauccucgccgccaccggcaaguccgacaagaucugcaucggcuaccacgccaacaacuccaccaccaaggucgacaccauccucgagaagaacgucaccgucacccacuccgucgagcuccucgagaaccagaaggagggccgcuucugcaagaucuccaacaaggccccccucgaccuccgcgacugcacccucgagggcuggauccucggcaacccccgcugcggcauccuccucgccgaccaguccugguccuacaucgucgagcgccccaacgcccgcaacggcaucugcuaccccggcauccucaacgaggccgaggagcucaaggcccucaucggcuccggcgagcgcgucgagcgcuucgagauguuccccaaguccaccugggccggcgucgacaccaacuccggcgucuccuccgccugcccccucggcaacggccccuccuucuaccgcaaccuccucuggaucaucaagcucaaguccuccgccuaccccgucauccgcggcaccuucaacaacaccggcgacaaguccauccucuacuucuggggcguccaccacccccccgucgccaccgagcaggaggcccucuacggcuccggcaaccgcuacguccgcaugggcaccgaguccaugaacuucgcccgcaaccccgagaucgccgcccgccccgccgucaacggccagcgcggccgcaucgacuacuucugguccauccucaagcccggcgagacccucaacgucgaguccaacggcaaccucaucgcccccugguacgccuaccgcuucgucaacaaggacuccaagggcgccaucuuccgcuccaaccuccccaucgagaacugcgaggccaccugccagaccaccgagggcgucauccgcaccaacaagaccuuccagaacgucuccccccucuggaucggcgagugccccaaguacgucaaguccaagucccuccgccucgccaccggccuccgcaacgucccccagaucgagacccgcggccucuucggcgccaucgccggcuucaucgagggcggcuggaccggcaugaucgacggcugguacggcuaccaccacgagaacucccagggcuccggcuacgccgccgaccgcgaguccacccagaaggccaucgacggcaucaccaacaaggucaacuccaucaucgacaagaugaacacccaguucgaggccgucggccacgaguucuccaaccucgagcgccgcaucgacaaccucaacaagcgcauggaggacggcuuccucgacgucuggaccuacaacgccgagcuccucguccuccucgagaacgagcgcacccucgaccuccacgacgccaacgucaagaaccuccacgagaagguccgcucccagcuccgcgacaacgccaacgaccucggcaacggcugcuucgaguucuggcacaagugcgacaacgagugcauggaguccgucaagaacggcaccuacgacuaccccaaguaccaggccgagucccgccucaaccgccagaagaucgaguccgucaagcucgagaacuucgacgucuaccagauccucgccaucuacuccaccgucuccuccucccucguccucgucggccucaucauggccaugggccucuggaugugcuccaacggcuccaugcagugccgcaucugcaucuga

SEQ ID NO: 102610 - RNA, 1701 nt, Artificial Sequence
  derived and/or modified sequence opt2 from hemagglutinin__InfluenzaA__AHJ57697
augaucgccuucaucgucaucgccauccucgccgccaccggcaaguccgacaagaucugcaucggcuaccacgccaacaacuccaccaccaaggucgacaccauccucgagaagaacgucaccgucacccacuccgucgagcuccucgagaaccagaaggaggagcgcuucugcaagaucuccaacaaggccccccucgaccuccgcgacugcacccucgagggcuggauccucggcaacccccgcugcggcauccuccucgccgaccaguccugguccuacaucgucgagcgccccaacgcccgcaacggcaucugcuaccccggcacccucaacgaggucgaggagcucaaggcccucaucggcuccggcgagcgcgucgagcgcuucgagauguuccccaaguccaccugggccggcgucgacaccaacuccggcgucuccuccgccugcccccucggcaacggccccuccuucuaccgcaaccuccucuggaucaucaagcucaaguccuccgaguaccccgucauccgcggcaccuucaacaacaccggcgacaaguccauccucuacuucuggggcguccaccacccccccgucaccaccgagcaggaggcccucuacggcuccggcgaccgcuacguccgcaugggcaccgaguccaugaacuucgcccgcucccccgagaucgccgcccgccccgccgucaacggccagcgcggccgcaucgacuacuucugguccauccucaagcccggcgagacccucaacgucgaguccaacggcaaccucaucgcccccugguacgccuaccgcuucgucaacaaggacuccaagggcgccaucuuccgcuccaaccuccccaucgagaacugcgacgccaccugccagaccaccgagggcgucauccgcaccaacaagaccuuccagaacgucuccccccucuggaucggcgagugccccaaguacgucaaguccaagucccuccgccucgccaccggccuccgcaacgucccccagaucgagacccgcggccucuucggcgccaucgccggcuucaucgagggcggcuggaccggcaugaucgacggcugguacggcuaccaccacgagaacucccagggcuccggcuacgccgccgaccgcgaguccacccagaaggccaucgacggcaucaccaacaaggucaacuccaucaucgacaagaugaacacccaguucgaggccgucggccacgaguucuccaaccucgagcgccgcaucgacaaccucaacaagcgcauggaggacggcuuccucgacgucuggaccuacaacgccgagcuccucguccuccucgagaacgagcgcacccucgaccuccacgacgccaacgucaagaaccuccacgagaaggucaagucccagcuccgcgacaacgccaacgaccucggcaacggcugcuucgaguucuggcacaagugcgacaacgagugcauggaguccgucaagaacggcaccuacgacuaccccaaguaccaggccgagucccgccucaaccgccagaagaucgaguccgucaagcucgagaacuucgacgucuaccagauccucgccaucuacuccaccgucuccuccucccucguccucgucggccucaucauggccaugggccucuggaugugcuccaacggcuccaugcagugccgcaucugcaucuga

SEQ ID NO: 102611 - RNA, 1701 nt, Artificial Sequence
  derived and/or modified sequence opt2 from hemagglutinin__InfluenzaA__AHJ57707
augaucgccuucaucgucaucgccauccucgucaccaccggcaaguccgacaagaucugcgucggcuaccacgccaacaacuccaccaccaaggucgacaccauccucgagaagaacgucaccgucacccacuccgucgagcuccucgagaaccagaaggaggagcgcuucugcaagaucuccaacaaggccccccucgaccuccgcgacugcacccucgagggcuggauccucggcaacccccgcugcggcauccuccucgccgaccaguccugguccuacaucgucgagcgccccaacgcccgcaacggcaucugcuaccccggcacccucaacgaggucgaggagcucaaggcccucaucggcuccggcgagcgcgucgagcgcuucgagauguuccccaaguccaccuggaccggcgucgacaccaacuccggcgucuccuccgccugcccccucggcgagggccccuccuucuaccgcaaccuccucuggaucaucaagcacaccaccuccggcuaccccgucaucaagggcaccuaccgcaacaccggcgacaaguccguccucuacuucuggggcguccaccacccccccgacaccaccgagcagaacguccucuacggcuccggcaaccgcuacguccgcaugggcaccgaguccaugaacuucgcccgcucccccgagaucgccgcccgccccgccgucaacggccagcgcggccgcaucgacuacuucugguccauccucaagcccggcgagacccucaacgucgaguccaacggcaaccucaucgcccccugguacgccuaccgcuucgucaacaaggacuccaagggcgccaucuuccgcuccaaccuccccaucgagaacugcgacgccaccugccagaccaccgagggcgucauccgcaccaacaagaccuuccagaacgucuccccccucuggaucggcgagugccccaaguacgucaaguccaagucccuccgccucgccaccggccuccgcaacgucccccagaucgagacccgcggccucuucggcgccaucgccggcuucaucgagggcggcuggaccggcaugaucgacggcugguacggcuaccaccacgagaacucccagggcuccggcuacgccgccgaccgcgaguccacccagaaggccaucgacggcaucaccaacaaggucaacuccaucaucgacaagaugaacacccaguucgaggccgucggccacgaguucuccaaccucgagcgccgcaucgacaaccucaacaagcgcauggaggacggcuuccucgacgucuggaccuacaacgccgagcuccucguccuccucgagaacgagcgcacccucgaccuccacgacgccaacgucaagaaccuccacgagcgcguccgcucccagcuccgcgacaacgccaacgaccucggcaacggcugcuucgaguucuggcacaagugcgacaacgagugcauggaguccgucaagaacggcaccuacaacuaccccaaguaccaggccgagucccgccucaacaagcagaagaucgaguccgucaagcucgaggaguucggcgucuaccagauccucgccaucuacuccaccgucuccuccucccucguccucgucggccucaucauggccaugggccucuggaugugcuccaacggcuccaugcagugccgcaucugcaucuga

SEQ ID NO: 102612 - RNA, 1701 nt, Artificial Sequence
  derived and/or modified sequence opt2 from hemagglutinin__InfluenzaA__AHJ57719
augaucgccuucaucgucaucgccauccucgccgccaccggcaaguccgacaagaucugcaucggcuaccacgccaacaacuccaccaccaaggucgacaccauccucgagaagaacgucaccgucacccacuccgucgagcuccucgagaaccagaaggaggagcgcuucugcaagaucuccaacaaggccccccucgaccuccgcgacugcacccucgagggcuggauccucggcaacccccgcugcggcauccuccucuccgaccaguccugguccuacaucgucgagcgccccaacgcccgcaacggcaucugcuaccccggcauccucaacgaggccgaggagcucaaggcccucaucggcuccggcgagcgcgucgagcgcuucgagauguuccccaaguccaccugggccggcgucgacaccaacuccggcgucuccuccgccugcccccucggcaacggccccuccuucuuccgcaaccuccucuggaucaucaagcucaaguccuccaccuaccccgucauccgcggcaccuucaacaacaccggcgacaaguccauccucuacuucuggggcguccaccaccccuccgucaccaccgagcaggaggcccucuacggcuccggcaaccgcuacguccgcaugggcaccgaguccaugaacuucgcccgcucccccgagaucgccgcccgccccgccgucaacggccagcgcggccgcaucgacuacuucugguccauccucaagcccggcgagacccucaacgucgaguccaacggcaaccucaucgcccccugguacgccuaccgcuucgucaacaaggacuccaagggcgccaucuuccgcuccaaccuccccaucgagaacugcgacgccaccugccagaccaucgagggcgucauccgcaccaacaagaccuuccagaacgucuccccccucuggaucggcgagugccccaaguacgucaaguccaagucccuccgccucgccaccggccuccgcaacgucccccagaucgagacccgcggccucuucggcgccaucgccggcuucaucgagggcggcuggaccggcaugaucgacggcugguacggcuaccaccacgagaacucccagggcuccggcuacgccgacgacaaggaguccacccagaaggccaucgacggcaucaccaacaaggucaacuccaucaucgacaagaugaacacccaguucgaggccgucggccacgaguucuccaaccucgagcgccgcaucgacaaccucaacaagcgcauggaggacggcuuccucgacgucuggaccuacaacgccgagcuccucguccuccucgagaacgagcgcacccucgaccuccacgacgccaacgucaagaaccuccacgagaagguccgcucccagcuccgcgacaacgccaacgaccucggcaacggcugcuucgaguucuggcacaagugcgacaacgagugcauggaguccgucaagaacggcaccuacgacuaccccaaguaccaggccgagucccgccucaaccgccagaagaucgaguccgucaagcucgagaacuucgacgucuaccagauccucgccaucuacuccaccgucuccuccucccucguccucgucggccucaucauggccaugggccucuggaugugcuccaacggcuccaugcagugccgcaucugcaucuga

SEQ ID NO: 102613 - RNA, 1701 nt, Artificial Sequence
  derived and/or modified sequence opt2 from hemagglutinin__InfluenzaA__AHJ57731
augaucgccuucaucgucaucgccauccucgccgccaccggcaaguccgacaagaucugcaucggcuaccacgccaacaacuccaccaccaaggucgacaccauccucgagaagaacgucaccgucacccacuccgucgagcuccucgagaaccagaaggaggagcgcuucugcaagaucuccaacaaggccccccucgaccuccgcgacugcacccucgagggcuggauccucggcaacccccgcugcggcauccuccucgccgaccaguccugguccuacaucgucgagcgccccaacgcccgcaacggcaucugcuaccccggcauccucaacgaggccgaggagcucaaggcccucaucggcuccggcgagcgcgucgagcgcuucgagauguuccccaaguccaccugggccggcgucgacaccgacuccggcgucuccuccgccugcccccucggcaacggccccuccuucuaccgcaaccuccucuggaucaucaagcucaaguccuccgaguaccccgucauccgcggcaccuucaacaacaccggcgacaaguccauccucuacuucuggggcguccaccacccccccgucaccaccgagcaggaggcccucuacggcuccggcaaccgcuacguccgcaugggcaccgaguccaugaacuucgcccgcucccccgagaucgccgcccgccccgccgucaacggccagcgcggccgcaucgacuacuucugguccauccucaagcccggcgagacccucaacgucgaguccaacggcaaccucaucgcccccugguacgccuaccgcuucgucaacaaggacuccaagggcgccaucuuccgcuccaaccuccccaucgagaacugcgacgccaccugccagaccaccgagggcgucauccgcaccaacaagaccuuccagaacgucuccccccucuggaucggcgagugccccaaguacgucaaguccaagucccuccgccucgccaccggccuccgcaacgucccccagaucgagacccgcggccucuucggcgccaucgccggcuucaucgagggcggcuggaccggcaugaucgacggcugguacggcuaccaccacgagaacucccagggcuccggcuacgccgccgaccgcgaguccacccagaaggccaucgacggcaucaccaacaaggucaacuccaucaucgacaagaugaacacccaguucgaggccgucggccacgaguucuccaaccucgagcgccgcaucgacaaccucaacaagcgcauggaggacggcuuccucgacgucuggaccuacaacgccgagcuccucguccuccucgagaacgagcgcacccucgaccuccacgacgccaacgucaagaaccuccacgagaagguccgcucccagcuccgcgacaacgccaacgaccucggcaacggcugcuucgaguucuggcacaagugcgacaacgagugcauggaguccgucaagaacggcaccuacgacuaccccaaguaccagaccgagucccgccucaaccgccagaagaucgaguccgucaagcucgagaacuucgacgucuaccagauccucgccaucuacuccaccgucuccuccucccucguccucgucggccucaucauggccaugggccucuggaugugcuccaacggcuccaugcagugccgcaucugcaucuga

SEQ ID NO: 102614 - RNA, 1701 nt, Artificial Sequence
  derived and/or modified sequence opt2 from hemagglutinin__InfluenzaA__AHJ57743
augaucgccuucaucgucaucgccauccucgucgccaccggcaaguccgacaagaucugcaucggcuaccacgccaacaacuccaccaccaaggucgacaccauccucgagaagaacgucaccgucacccacuccgucgagcuccucgagaaccagaaggaggagcgcuucugcaagaucuccaacaaggccccccucgaccuccgcgacugcaccaucgagggcuggauccucggcaacccccgcugcggcauccuccucgccgaccaguccugguccuacaucgucgagcgccccgacgcccgcaacggcaucugcuaccccggcacccucaacgaggccgaggagcucaaggcccucaucggcuccggcgagaaggucgagcgcuucgagauguuccccaaguccaccugggccggcgucgacaccuccuccggcgucuccuccgccugcccccucggcaacggccccuccuucuaccgcaaccuccucuggaucaucaagcucaaguccuccgaguaccccgucauccgcggcaccuucaacaacaccggcgacaaguccguccucuacuucuggggcguccaccacccccccgucaccaccgagcagaacgcccucuacggcuccggcaaccgcuacguccgcaugggcaccgaguccaugaacuucgcccgcucccccgagaucgccgcccgccccgccgucaacggccagcgcggccgcaucgacuacuucugguccauccucaagcccggcgagacccucaacgucgaguccaacggcaaccucaucgcccccugguacgccuaccgcuucgucaacaaggacuccaagggcgccaucuuccgcuccaaccuccccaucgagaacugcgacgccaccugccagaccaucgagggcgucauccgcaccaacaagaccuuccagaacgucuccccccucuggaucggcgagugccccaaguacgucaaguccaagucccuccgccucgccaccggccuccgcaacgucccccagaucgagacccgcggccucuucggcgccaucgccggcuucaucgagggcggcuggaccggcaugaucgacggcugguacggcuaccaccacgagaacucccagggcuccggcuacgccgccgaccgcgaguccacccagaaggccaucgacggcaucaccaacaaggucaacuccaucaucgacaagaugaacacccaguucgaggccgccggccacgaguucuccaaccucgagcgccgcaucgacaaccucaacaagcgcauggaggacggcuuccucgacgucuggaccuacaacgccgagcuccucguccuccucgagaacgagcgcacccucgaccuccacgacgccaacgucaagaaccuccacgagaaggucaagucccagcuccgcgacaacgccaacgaccucggcaacggcugcuucgaguucuggcacaagugcgacaacgagugcauggaguccgucaagaacggcaccuacgacuaccccaaguaccagaaggagucccgccucaaccgccagaagaucgaguccgucaagcucgagaacuucgacgucuaccagauccucgccaucuacuccaccgucuccuccucccucguccucgucggccucaucauggccaugggccucuggaugugcuccaacggcuccaugcagugccgcaucugcaucuga

SEQ ID NO: 102615 - RNA, 1701 nt, Artificial Sequence
  derived and/or modified sequence opt2 from hemagglutinin__InfluenzaA__AHJ57755
augaucgccuucaucgucaucgccauccucgucgccaccggcaaguccgacaagaucugcaucggcuaccacgccaacaacuccaccaccaaggucgacaccauccucgagaagaacgucaccgucacccacuccgucgagcuccucgagaaccagaaggaggagcgcuucugcaagaucuccaacaaggccccccucgaccuccgcgacugcaccaucgagggcuggauccucggcaacccccgcugcgacauccuccucgccgaccaguccugguccuacaucgucgagcgccccaacgcccgcaacggcaucugcuaccccggcacccucaacgaggccgaggagcucaaggcccucaucggcuccggcgagggcgucgagcgcuucgagauguuccccaaguccaccugggucggcgucgacaccuccuccggcgucuccuccgccugcccccucggcaacggccccuccuucuaccgcaaccuccucuggaucaucaagcucaaguccuccgaguaccccgucauccgcggcaccuucaacaacaccggcgacaaguccguccucuacuucuggggcguccaccacccccccgucaccaccgagcagaacgcccucuacggcuccggcaaccgcuacguccgcaugggcaccgaguccaugaacuucgcccgcucccccgagaucgccgcccgccccgccgucaacggccagcgcggccgcaucgacuacuucugguccauccucaagcccggcgagacccucaacgucgaguccaacggcaaccucaucgcccccugguacgccuaccgcuucgucaacaaggacaacaagggcgccaucuuccgcuccaaccuccccaucgagaacugcgacgccaccugccagaccaccgagggcgucauccgcaccaacaagaccuuccagaacgucuccccccucuggaucggcgagugccccaaguacgucaaguccaagucccuccgccucgccaccggccuccgcaacgucccccagaucgagacccgcggccucuucggcgccaucgccggcuucaucgagggcggcuggaccggcaugaucgacggcugguacggcuaccaccacgagaacucccagggcuccggcuacgccgccgaccgcgaguccacccagaaggccaucgacggcaucaccaacaaggucaacuccaucaucgacaagaugaacacccaguucgaggccgccggccacgaguucuccaaccucgagcgccgcaucgacaaccucaacaagcgcauggaggacggcuuccucgacgucuggaccuacaacgccgagcuccucguccuccucgagaacgagcgcacccucgaccuccacgacgccaacgucaagaaccuccacgagaaggucaagucccagcuccgcgacaacgccaacgaccucggcaacggcugcuucgaguucuggcacaagugcgacaacgagugcauggaguccgucaagaacggcaccuacgacuaccccaaguaccagaaggagucccgccucaaccgccagaagaucgaguccgucaagcucgagaacuucgacgucuaccagauccucgccaucuacuccaccgucuccuccucccucgucgucgucggccucaucauggccaugggccucuggaugugcuccaacggcuccaugcagugccgcaucugcaucuga

SEQ ID NO: 102616 - RNA, 1701 nt, Artificial Sequence
  derived and/or modified sequence opt2 from hemagglutinin__InfluenzaA__AHJ57767
augaucgccuucaucgucaucgccauccucgccgccaccggcaaguccgacaagaucugcaucggcuaccacgccaacaacuccaccaccaaggucgacaccauccucgagaagaacgucaccgucacccacuccgucgagcuccucgagaaccagaaggaggagcgcuucugcaagaucuccaacaaggccccccucgaccuccgcgacugcacccucgagggcuggauccucggcaacccccgcugcggcauccuccucgccgaccaguccugguccuacaucgucgagcgccccaacgcccgcaacggcaucugcuaccccggcacccucaacgaggucgaggagcucaaggcccucaucggcuccggcgagcgcgucgagcgcuucgagauguuccccaaguccaccugggccggcgucgacaccaacuccggcgucuccuccgccugcccccucggcaacggccccuccuucuaccgcaaccuccucuggaucaucaagcucaaguccuccgaguaccccgucauccgcggcaccuucaacaacaccggcgacaaguccauccucuacuucuggggcguccaccacccccccgucaccaccgagcaggaggcccucuacggcuccggcgaccgcuacguccgcaugggcaccgaguccaugaacuucgcccgcucccccgagaucgccgcccgccccgccgucaacggccagcgcggccgcaucgacuacuucugguccauccucaagcccggcgagacccucaacgucgaguccaacggcaaccucaucgcccccugguacgccuaccgcuucgucaacaaggacuccaagggcgccaucuuccgcuccaaccuccccaucgagaacugcgacgccaccugccagaccaccgagggcgucauccgcaccaacaagaccuuccagaacgucuccccccucuggaucggcgagugccccaaguacgucaaguccaagucccuccgccucgccaccggccuccgcaacgucccccagaucgagacccgcggccucuucggcgccaucgccggcuucaucgagggcggcuggaccggcaugaucgacggcugguacggcuaccaccacgaguccucccagggcuccggcuacgccgccgacaaggaguccacccagaaggccaucgacggcaucaccaacaaggucaacuccaucaucgacaagaugaacacccaguucgaggccgucggccacgaguucuccaaccucgagcgccgcaucgacaaccucaacaagcgcauggaggacggcuuccucgacgucuggaccuacaacgccgagcuccucguccuccucgagaacgagcgcacccucgaccuccacgacgccaacgucaagaaccuccacgagaagguccgcucccagcuccgcgacaacgccaacgaccucggcaacggcugcuucgaguucuggcacaagugcaacaacgagugcauggaguccgucaagaacggcaccuacgacuaccccaaguaccagaaggagucccgccucaaccgccagaagaucgaguccgucaagcucgagaacuucgacgucuaccagauccucgccaucuacuccaccgucuccuccucccucguccucgucggccucauccucgccaugggccucuggaugugcuccaacggcuccaugcagugccgcaucugcaucuga

SEQ ID NO: 102617 - RNA, 1701 nt, Artificial Sequence
  derived and/or modified sequence opt2 from hemagglutinin__InfluenzaA__AHJ57779
augaucgccaucaucaucaucgccauccucgucgccaccggcaaguccgacaagaucugcaucggcuaccacgccaacaacuccaccaccaaggucgacaccauccucgagaagaacgucaccgucacccacuccgucgagcuccucgaggaccagaaggaggagcgcuucugcaagaucuccaacaaggccccccucgaccuccgcgacugcaccaucgagggcuggauccucggcaacccccgcugcggcauccuccucgccgaccaguccugguccuacaucgucgagcgccccaacgcccgcaacggcaucugcuaccccggcacccucaacgaggccgaggagcucaaggcccucaucggcuccggcgagggcgucgagcgcuucgagauguuccccaaguccaccugggccggcgucgacaccaacuccggcgucuccuccgccugcccccucggcaacggccccuccuucuaccgcaaccuccucuggaucaucaagcucaaguccuccgaguaccccgucauccgcggcaccuucaacaacaccggcgacaaguccguccucuacuucuggggcguccaccacccccccgucaccaccgagcagaacgcccucuacggcuccggcaaccgcuacguccgcaugggcaccgaguccaugaacuucgcccgcucccccgagaucgccgcccgccccgccgucaacggccagcgcggccgcaucgacuacuucugguccauccucaagcccggcgagacccucaacgucgaguccaacggcaaccucaucgcccccugguacgccuaccgcuucgucaacaaggacuccaagggcgccaucuuccgcuccaaccuccccaucgagaacugcgacgccaccugccagaccaccgagggcgucauccgcaccaacaagaccuuccagaacgucuccccccucuggaucggcgagugccccaaguacgucaaguccaagucccuccgccucgccaccggccuccgcaacgucccccagaucgagacccgcggccucuucggcgccaucgccggcuucaucgagggcggcuggaccggcaugaucgacggcugguacggcuaccaccacgagaacucccagggcuccggcuacgccgccgaccgcgaguccacccagaaggccaucgacggcaucaccaacaaggucaacuccaucaucgacaagaugaacacccaguucgaggccgccggccacgaguucuccaaccucgagcgccgcaucgacaaccucaacaagcgcauggaggacggcuuccucgacgucuggaccuacaacgccgagcuccucguccuccucgagaacgagcgcacccucgaccuccacgacgccaacgucaagaaccuccacgagaaggucaagucccagcuccgcgacaacgccaacgaccucggcaacggcugcuucgaguucuggcacaagugcgacaacgagugcauggaguccgucaagaacggcaccuacgacuaccccaaguaccagaaggagucccgccucaaccgccagaagaucgaguccgucaagcucgagaacuucgacgucuaccagauccucgccaucuacuccaccgucuccuccucccucguccucgucggccucaucauggccaugggccucuggaugugcuccaacggcuccaugcagugcaugaucugcaucuga

SEQ ID NO: 102618 - RNA, 1701 nt, Artificial Sequence
  derived and/or modified sequence opt2 from hemagglutinin__InfluenzaA__AHJ57791
augaucgccaucaucaucaucgccauccucgucaccaccggcaaguccgacaagaucugcaucggcuaccacgccaacaacuccaccaccaaggucgacaccauccucgagaagaacgucaccgucacccacuccgucgagcuccucgagaacaagaaggaggagcgcuucugcaagaucuccaacaaggccccccucgaccuccgcgacugcacccucgagggcuggauccucggcaacccccgcugcggcauccuccucgccgaccaguccugguccuacaucgucgagcgccccaacgcccgcaacggcaucugcuaccccggcacccucaacgaggucaaggagcucaaggcccucaucggcuccggcgagcgcgucaagcgcuucgagauguuccccaaguccaccugggccggcgucgacaccaacuccggcgucuccuccuccugcccccucggcaacggccccuccuucuaccgcaaccuccucuggaucaucaagcacaccaccuccggcuaccccgucaucaagggcaccuacaccaacaccggcgacaaguccguccucuacuucuggggcauccaccacccccccgacaccaccgagcagaacguccucuacggcuccggcaaccgcuacguccgcaugggcaccgaguccaugaacuucgcccgcucccccgagaucgccgcccgccccgccgucaacggccagcgcggccgcaucgacuacuucugguccauccucaagcccggcgagacccucaacgucgaguccaacggcaaccucaucgcccccugguacgccuaccgcuucgucaacaaggacuccaagggcgccaucuuccgcuccaaccuccccaucgaggacugcgacgccaccugccagaccaccgagggcgucauccgcaccaacaagaccuuccagaacgucuccccccucuggaucggcgagugccccaaguacgucaaguccaagucccuccgccucgccaccggccuccgcaacgucccccagaucgagacccgcggccucuucggcgccaucgccggcuucaucgagggcggcuggaccggcaugaucgacggcugguacggcuaccaccacgagaacucccagggcuccggcuacgccgccgaccgcgaguccacccagaaggccaucgacggcaucaccaacaaggucaacuccaucaucgacaagaugaacacccaguucgaggccgucggccacgaguucuccaaccucgagcgccgcaucgacacccucaacaagcgcauggaggacggcuuccucgacgucuggaccuacaacgccgagcuccucguccuccucgagaacgagcgcacccucgaccuccacgacgccaacgucaagaaccuccacgagcgcgucaagucccagcuccgcgacaacgccaacgaccucggcaacggcugcuucgaguucuggcacaagugcgacaacgagugcauggaguccgucaagaacggcaccuacaacuaccccaaguaccaggccgagucccgccucaacaagcagaagaucgaguccgucaagcucgaggaguucggcgucuaccagauccucgccaucuacuccaccgucuccuccucccucguccucgucggccucaucauggccaugguccucuggaugugcuccaacggcuccaugcagugccgcgucugcaucuga

SEQ ID NO: 102619 - RNA, 1701 nt, Artificial Sequence
  derived and/or modified sequence opt2 from hemagglutinin__InfluenzaA__AHJ57815
augaucgccuucaucaucaucaccauccucgucaccaccggcaaguccgacaagaucugcaucggcuaccacgccaacaacuccaccaccaaggucgacaccauccucgagaagaacgucaccgucacccacuccgucgagcuccucgagaaccagaaggaggagcgcuucugccgcaucuccaacaaggccccccucgaccucaaggagugcacccucgagggcuggauccucggcaacccccagugcgaccuccuccucggcgaccaguccugguccuacaucgucgagcgccccaacgcccgcaacggcaucugcuaccccggcacccucaacgaggucgaggagcuccgcgcccucaucggcuccggcgagggcgucgagcgcuucgagauguuccccaaguccaccugggccggcgucgacaccaaccgcggcgucaccuccuccugccccuucggcuccggcuccuccuucuaccgcaaccuccucuggaucgucaagcacaccaccuccuccuaccccgucaucaagggcaccuuccgcaacaccggcgacaaguccguccucuacuucuggggcguccaccaccccuucgacaccaacgagcagaacguccucuacggcuccggcaaccgcuacguccgcaugggcaccgaguccaugaacuucgcccgcggccccgaggucgccgcccgccccgucgucaacggccagcgcggccgcaucgacuacuucugguccauccucaagcccggcgagacccucaacaucgaguccaacggcaaccucaucgcccccugguacgccuaccgcuucgucaacaaggacuccaagggcgccaucuuccgcuccaaccuccccaucgaggacugcgacgccaccugccagaccaucgagggcgucauccgcaccaacaagaccuuccagaacgucuccccccucuggaucggcgagugccccaaguacgucaaguccgagucccuccgccucgccaccggccuccgcaacgucccccagaucgagacccgcggccucuucggcgccaucgccggcuucaucgagggcggcuggaccggcaugaucgacggcugguacggcuaccaccacgagaacucccagggcuccggcuacgccgccgaccgcgaguccacccagaaggccaucgacggcaucaccaccaaggucaacuccaucaucgacaagaugaacacccaguucgaggccgucggccacgaguucuccaaccucgagcgccgcaucgacaaccucaacaagcgccucgaggacggcuuccucgacgucuggaccuacaacgccgagcuccucguccuccucgagaacgagcgcacccucgaccuccacgacgccaacgucaagaaccuccacgagcgcguccgcucccagcuccgcgacaacgccaacgaccucggcaacggcugcuucgaguucuggcacaagugcgacaacgagugcauggaguccgucaagaacggcaccuacaacuaccccaaguaccaggccgagucccgccucaacaagcagcgcaucgaguccgucaagcucgagaacuucgacgucuaccagauccucgccaucuacuccaccgucuccuccucccucguccucgucggccucauccucgccaugggccucuggaugugcuccaacggcuccaugcagugccgcaucugcaucuga

SEQ ID NO: 102620 - RNA, 1701 nt, Artificial Sequence
  derived and/or modified sequence opt2 from hemagglutinin__InfluenzaA__AHJ57827
augaucgccuucaucgucaucgccauccucgucgccaccggcaaguccgacaagaucugcaucggcuaccacgccaacaacuccaccaccaaggucgacaccauccucgagaagaacgucaccgucacccacuccgucgagcuccucgagaaccagaaggaggagcgcuucugcaagaucuccaacaaggccccccucgaccuccgcgacugcaccaucgagggcuggauccucggcaacccccgcugcggcauccuccucgccgaccaguccugguccuacaucgucgagcgccccaacgcccgcaacggcaucugcuaccccggcacccucaacgaggucgaggagcucaaggcccucaucggcuccggcgagcgcgucgagcgcuucgagauguuccccaaguccaccugggccggcgucgacaccaacuccggcgucuccuccgccugcccccucggcaacggccccuccuucuaccgcaaccuccucuggaucaucaagaccaaguccuccgaguaccccgucaucaagggcaccuucaacaacaccggcgacaaguccguccucuacuucuggggcguccaccacccccccucccgcaacgagcagaacguccucuacggcuccggcgaccgcuacguccgcaugggcaccgaguccaugaacuucgcccgcucccccgagaucgccgcccgccccgccgucaacggccagcgcggccgcaucgacuacuucugguccauccucaagcccggcgagacccucaacgucgaguccaacggcaaccucaucgcccccugguacgccuaccgcuucgucaacaaggacucccgcggcgccaucuuccgcuccaaccuccccaucgagaacugcgacgccaccugccagaccgccgagggcgucauccgcaccaacaagaccuuccagaacgucuccccccucuggaucggcgagugccccaaguacgucaaguccaagucccuccgccucgccaccggccuccgcaacgucccccagaucgagacccgcggccucuucggcgccaucgccggcuucaucgagggcggcuggaccggcaugaucgacggcugguacggcuaccaccacgagaacucccagggcuccggcuacgccgccgaccgcgaguccacccagaaggccaucgacggcaucaccaacaaggucaacuccaucaucgacaagaugaacacccaguucgaggccgucggccacgaguucuccaaccucgagcgccgcaucgacaaccucaacaagcgcauggaggacggcuuccucgacgucuggaccuacaacgccgagcuccucguccuccucgagaacgagcgcacccucgaccuccacgacgccaacgucaagaaccuccacgagcgcgucaagucccagcuccgcgacaacgccaacgaccucggcaacggcugcuucgaguucuggcacaagugcgacaacgagugcauggaguccgucaagaacggcaccuacgacuaccccaaguaccagaaggagucccgccucaaccgccagaagaucgaguccgucaagcucgagaacuucgacgucuaccagauccucgccaucuacuccaccgucuccuccucccucguccucgucggccucaucauggccaugggccucuggaugugcuccaacggcuccaugcagugccgcaucugcaucuga

SEQ ID NO: 102621 - RNA, 1701 nt, Artificial Sequence
  derived and/or modified sequence opt2 from hemagglutinin__InfluenzaA__AHJ57850
augaucgccuucaucgucaucgccauccucgccaccaccggcaaguccgacaagaucugcaucggcuaccacgccaacaacuccaccaccaaggucgacaccauccucgagaagaacgucaccgucacccacuccgucgagcuccucgagaaccagaaggaggagcgcuucugcaagaucuccaacaaggccccccucgaccuccgcgacugcacccucgagggcuggauccucggcaacccccgcugcggcauccuccucgccgaccaguccugguccuacaucgucgagcgccccaacgcccgcaacggcaucugcuaccccggcauccucaacgaggccgaggagcucaaggcccucaucggcuccggcgagcgcgucgagcgcuucgagauguuccccaaguccaccugggccggcgucgacaccgacuccggcgucuccuccgccugcccccucggcaacggccccuccuucuaccgcaaccuccucuggaucaucaagcucaaguccuccgaguaccccgucauccgcggcaccuucaacaacaccggcgacaaguccauccucuacuucuggggcguccaccacccccccgucaccaccgagcaggaggcccucuacggcuccggcaaccgcuacguccgcaugggcaccgaguccaugaacuucgcccgcacccccgagaucgccgcccgccccgccgucaacggccagcgcggccgcaucgacuacuucugguccauccucaagcccggcgagacccucaacgucgaguccaacggcaaccucaucgcccccugguacgccuaccgcuucgucaacaaggacuccaagggcgccaucuuccgcuccaaccuccccaucgagaacugcgacgccaccugccagaccaccgagggcgucauccgcaccaacaagaccuuccagaacgucuccccccucuggaucggcgagugccccaaguacgucaaguccaagucccuccgccucgccaccggccuccgcaacgucccccagaucgagacccgcggccucuucggcgccaucgccggcuucaucgagggcggcuggaccggcaugaucgacggcugguacggcuaccaccacgagaacucccagggcuccggcuacgccgccgaccgcgaguccacccagaaggccaucgacggcaucaccaacaaggucaacuccaucaucgacaagaugaacacccaguucgaggccgucggccacgaguucuccaaccucgagcgccgcaucgacaaccucaacaagcgcauggaggacggcuuccucgacgucuggaccuacaacgccgagcuccucguccuccucgagaacgagcgcacccucgaccuccacgacgccaacgucaagaaccuccacgagaagguccgcucccagcuccgcgacaacgccaacgaccucggcaacggcugcuucgaguucuggcacaagugcgacaacgagugcauggaguccgucaagaacggcaccuacgacuaccccaaguaccaggccgagucccgccucaaccgccagaagaucgaguccgucaagcucgagaacuucgacgucuaccagauccucgccaucuacuccaccgucuccuccucccucguccucgucggccucaucauggccaugggccucuggaugugcuccaacggcuccaugcagugccgcaucugcaucuga

SEQ ID NO: 102622 - RNA, 1701 nt, Artificial Sequence
  derived and/or modified sequence opt2 from hemagglutinin__InfluenzaA__AHJ57862
augaucgccuucaucgucaucgccauccucgccgccaccggcaaguccgacaagaucugcaucggcuaccacgccaacaacuccaccaccaaggucgacaccauccucgagaagaacgucaccgucacccacuccgucgagcuccucgagaaccagaaggaggagcgcuucugcaagaucuccaacaaggccccccucgaccuccgcgacugcacccucgagggcuggauccucggcaacccccgcugcggcauccuccucgccgaccaguccugguccuacaucgucgagcgccccaacgcccgcaacggcaucugcuaccccggcauccucaacgaggccgaggagcucaaggcccucaucggcuccggcgagcgcgucgagcgcuucgagauguuccccaaguccaccugggccggcgucgacaccaacuccggcgucuccuccgccugcccccucggcaacggccccuccuucuaccgcaaccuccucuggaucaucaagcucaaguccuccgaguaccccgucauccgcggcaccuucaacaacaccggcgacaaguccauccucuacuucuggggcguccaccacccccccgucaccaccgagcaggaggcccucuacggcuccggcaaccgcuacguccgcaugggcaccgaguccaugaacuucgcccgcucccccgagaucgccgcccgccccgccgucaacggccagcgcggccgcaucgacuacuucugguccauccucaagcccggcgagacccucaacgucgaguccaacggcaaccucaucgcccccugguacgccuaccgcuucgucaacaaggacuccaagggcgccaucuuccgcuccaaccuccccaucgagaacugcgacgccaccugccagaccaccgagggcgucauccgcaccaacaagaccuuccagaacgucuccccccucuggaucggcgagugccccaaguacgucaaguccaagucccuccgccucgccaccggccuccgcaacgucccccagaucgagacccgcggccucuucggcgccaucgccggcuucaucgagggcggcuggaccggcaugaucgacggcugguacggcuaccaccacgagaacucccagggcuccggcuacgccgccgaccgcgaguccacccagaaggccaucgacggcaucaccaacaaggucaacuccaucaucgacaagaugaacacccaguucgaggccgucggccacgaguucuccaaccucgagcgccgcaucgacaaccucaacaagcgcauggaggacggcuuccucgacgucuggaccuacaacgccgagcuccucguccuccucgagaacgagcgcacccucgaccuccacgacgccaacgucaagaaccuccacgagaagguccgcucccagcuccgcgacaacgccaacgaccucggcaacggcugcuucgaguucuggcacaagugcgacaacgagugcauggaguccgucaagaacggcaccuacgacuaccccaaguaccaggccgagucccgccucaaccgccagaagaucgaguccgucaagcucgagaacuucgacgucuaccagauccucgccaucuacuccaccgucuccuccucccucguccucgucggccucaucauggccaugggccucuggaugugcuccaacggcuccaugcagugccgcaucugcaucuga

SEQ ID NO: 102623 - RNA, 1701 nt, Artificial Sequence
  derived and/or modified sequence opt2 from hemagglutinin__InfluenzaA__AHJ57873
augaucgccuucaucgucaucgccacccucgucgccaccggcaaguccgacaagaucugcaugggcuaccacgccaacaacuccaccaccaaggucgacaccauccucgagaagaacgucaccgucacccacuccgucgagcuccucgagaaccagaaggaggagcgcuucugcaagaucuccaacaaggccccccucgaccuccgcgacugcacccucgagggcuggauccucggcaacccccgcugcggcauccuccucgccgaccaguccugguccuacaucgucgagcgccccaacgcccgcaacggcaucugcuaccccggcacccucaacgaggccgaggagcucaaggcccucaucggcuccggcgagcgcgucgagcgcuucgagauguuccccaaguccaccuggaccggcgucgacaccgaguccggcgucuccuccgccugcccccucggcaacggccccuccuucuaccgcaaccuccucuggaucaucaagcucaaguccuccgaguaccccgucauccgcggcaccuucaacaacaccggcgacaaguccauccucuacuucuggggcguccaccacccccccgucaccaccgagcagaacgcccucuacggcuccggcgaccgcuacguccgcaugggcaccgaguccaugaacuucgcccgcucccccgagaucgccgcccgccccgccgucaacggccagcgcggccgcaucgacuacuucugguccauccucacccccggcgagacccucaacgucgaguccaacggcaaccucaucgcccccugguacgccuaccgcuucgucaacaaggacuccaagggcgccaucuuccgcuccaaccuccccaucgagaacugcgacgccaccugccagaccaccgagggcgucauccgcaccaacaagaccuuccagaacgucuccccccucuggaucggcgagugccccaaguacgucaaguccaagucccuccgccucgccaccggccuccgcaacgucccccagaucgagacccgcggccucuucggcgccaucgccggcuucaucgagggcggcuggaccggcaugaucgacggcugguacggcuaccaccacgagaacucccagggcuccggcuacgccgccgacaaggaguccacccagaaggccaucgacggcaucaccaacaaggucaacuccaucaucgacaagaugaacacccaguucgaggccgucggccacgaguucuccaaccucgagcgccgcaucgacaaccucaacaagcgcauggaggacggcuuccucgacgucuggaccuacaacgccgagcuccucguccuccucgagaacgagcgcacccucgaccuccacgacgccaacgucaagaaccuccacgagaagguccgcucccagcuccgcgacaacgccaacgaccucggcaacggcugcuucgaguucuggcacaagugcgacaacgagugcauggaguccgucaagaacggcaccuacgacuaccccaaguaccagaaggagucccgccucaaccgccagaagaucgaguccgucaagcucgagaacuucgacgucuaccagauccucgccaucuacuccaccgucuccuccucccucguccucgucggccucauccucgccaugggccucuggaugugcuccaacggcuccaugcacugccgcaucugcaucuga

SEQ ID NO: 102624 - RNA, 1701 nt, Artificial Sequence
  derived and/or modified sequence opt2 from hemagglutinin__InfluenzaA__AHJ57885
augaucgccuucaucgucauggccauccucgccgccaccggcaaguccgacaagaucugcaucggcuaccacgccaacaacuccaccaccaaggucgacaccauccucgagaagaacgucaccgucacccacuccgucgagcuccucgagaaccagaaggaggagcgcuucugcaagaucuccaacaaggccccccucgaccuccgcgacugcacccucgagggcuggauccucggcaacccccgcugcggcauccuccucgccgaccaguccugguccuacaucgucgagcgccccaacgcccgcaacggcaucugcuaccccggcauccucaacgaggccgaggagcucaaggcccucaucggcuccggcgagcgcgucgagcgcuucgagauguuccccaaguccaccugggccggcgucgacaccgacuccggcgucuccuccgccugcccccucggcaacggccccuccuucuaccgcaaccuccucuggaucaucaagcgcaaguccuccgccuaccccgucauccgcggcaccuucaacaacaccggcgacaaguccauccucuacuucuggggcguccaccacccccccgucaccaccgagcaggaggcccucuacggcuccggcaaccgcuacguccgcaugggcaccgaguccaugaacuucgcccgcaaccccgagaucgccgcccgccccgccgucaacggccagcgcggccgcaucgacuacuucugguccauccucaagcccggcgagacccucaacaucgaguccaacggcaaccucaucgcccccugguacgccuaccgcuucgucaacaaggacuccaagggcgccaucuuccgcuccaaccuccccaucgaggacugcgacgccuccugccagaccaccgagggcgucauccgcaccaacaagaccuuccagaacgucuccccccucuggaucggcgagugccccaaguacgucaaguccaagucccuccgccucgccaccggccuccgcaacgucccccagaucgagacccgcggccucuucggcgccaucgccggcuucaucgagggcggcuggaccggcaugaucgacggcugguacggcuaccaccacgagaacucccagggcuccggcuacgccgccgaccgcgaguccacccagaaggccaucgacggcaucaccaacaaggucaacuccaucaucgacaagaugaacacccaguucgaggccgucggccacgaguucuccaaccucgagcgccgcaucgacaaccucgacaagcgcauggaggacggcuuccucgacgucuggaccuacaacgccgagcuccucguccuccucgagaacgagcgcacccucgaccuccacgacgccaacgucaagaaccuccacgagaagguccgcucccagcuccgcgacaacgccaacgaccucggcaacggcugcuucgaguucuggcacaagugcgacaacgagugcauggaguccgucaagaacggcaccuacgacuaccccaaguaccaggccgagucccgccucaaccgccagaagaucgaguccgucaagcucgagaacuucgacgucuaccagauccucgccaucuacuccaccgucuccuccucccucguccucgucggccucaucauggccaugggccucuggaugugcuccaacggcuccaugcagugccgcaucugcaucuga

SEQ ID NO: 102625 - RNA, 1701 nt, Artificial Sequence
  derived and/or modified sequence opt2 from hemagglutinin__InfluenzaA__AHJ57897
augaucgccuucaucgucaucgccauccucgccgccaccggcaaguccgacaagaucugcaucggcuaccacgccaacaacuccaccaccaaggucgacaccauccucgagaagaacgucaccgucacccacuccgucgagcuccucgagaaccagaaggaggagcgcuucugcaagaucuccaacaaggccccccucgaccuccgcgacugcacccucgagggcuggauccucggcaacccccgcugcggcauccuccucgccgaccaguccugguccuacaucgucgagcgccccaacgcccgcaacggcaucugcuaccccggcauccucaacgaggccgaggagcucaaggcccucaucggcuccggcgagcgcgucgagcgcuucgagauguuccccaaguccaccugggccggcgucgacaccgacuccggcgucuccuccgccugcccccucggcaacggccccuccuucuaccgcaaccuccucuggaucaucaagcgcaaguccuccgccuaccccgucauccgcggcaccuucaacaacaccggcgacaaguccauccucuacuucuggggcguccaccacccccccgucaccaccgagcaggaggcccucuacggcuccggcaaccgcuacguccgcaugggcaccgaguccaugaacuucgcccgcaaccccgagaucgccgcccgccccgccgucaacggccagcgcggccgcaucgacuacuucugguccauccucaagcccggcgagacccucaacaucgaguccaacggcaaccucaucgcccccugguacgccuaccgcuucgucaacaaggacuccaagggcgccaucuuccgcuccaaccuccccaucgaggacugcgacgccuccugccagaccaccgagggcgucauccgcaccaacaagaccuuccagaacgucuccccccucuggaucggcgagugccccaaguacgucaaguccaagucccuccgccucgccaccggccuccgcaacgucccccagaucgagacccgcggccucuucggcgccaucgccggcuucaucgagggcggcuggaccggcaugaucgacggcugguacggcuaccaccacgagaacucccagggcuccggcuacgccgccgaccgcgaguccacccagaaggccaucgacggcaucaccaacaaggucaacuccaucaucgacaagaugaacacccaguucgaggccgucggccacgaguucuccaaccucgagcgccgcaucgacaaccucaacaagcgcauggaggacggcuuccucgacgucuggaccuacaacgccgagcuccucguccuccucgagaacgagcgcacccucgaccuccacgacgccaacgucaagaaccuccacgagaagguccgcucccagcuccgcgacaacgccaacgaccucggcaacggcugcuucgaguucuggcacaagugcgacaacgagugcauggaguccgucaagaacggcaccuacgacuaccccaaguaccaggccgagucccgccucaaccgccagaagaucgaguccgucaagcucgagaacuucgacgucuaccagauccucgccaucuacuccaccgucuccuccucccucguccucgucggccucaucauggccaugggccucuggaugugcuccaacggcuccaugcagugccgcaucugcaucuga

SEQ ID NO: 102626 - RNA, 1701 nt, Artificial Sequence
  derived and/or modified sequence opt2 from hemagglutinin__InfluenzaA__AHJ57908
augaucgccuucaucgucaucgccauccucgucgccaccggcaaguccgacaagaucugcaucggcuaccacgccaacaacuccaccaccaaggucgacaccauccucgagaagaacgucaccgucacccacuccgucgagcuccucgagaaccagaaggaggagcgcuucugcaagaucuccaacaaggccccccucgaccuccgcgacugcaccgucgagggcuggauccucggcaacccccgcugcggcauccucaucgccgaccaguccugguccuacaucgucgagcgccccaacgcccgcaacggcaucugcuaccccggcacccucaacgaggccgaggagcucaaggcccucaucggcuccggcgagggcgucgagcgcuucgagauguuccccaaguccaccugggccggcgucgacaccuccuccggcgucuccuccgccugcccccucggcaacggccccuccuucuaccgcaaccuccucuggaucaucaagcucaaguccuccgaguaccccgucauccgcggcaccuucaacaacaccggcgacaaguccguccucuacuucuggggcguccaccacccccccgucaccaccgagcaggacgcccucuacggcuccggcaaccgcuacguccgcaugggcaccgaguccaugaacuucgcccgcucccccgagaucgccgcccgccccgccgucaacggccagcgcggccgcaucgacuacuucugguccguccucaagcccggcgagacccucaacgucgaguccaacggcaaccucaucgcccccugguacgccuaccgcuucgucaacaaggacaacaagggcgccaucuuccgcuccaaccuccccaucgagaacugcgacgccaccugccagaccaccgagggcgucauccgcaccaacaagaccuuccagaacgucuccccccucuggaucggcgagugccccaaguacgucaaguccaagucccuccgccucgccaccggccuccgcaacgucccccagaucgagacccgcggccucuucggcgccaucgccggcuucaucgagggcggcuggaccggcaugaucgacggcugguacggcuaccaccacgagaacucccagggcuccggcuacgccgccgaccgcgaguccacccagaaggccaucgacggcaucaccaacaaggucaacuccaucaucgacaagaugaacacccaguucgaggccgccggccacgaguucuccaaccucgagcgccgcaucgacaaccucaacaagcgcauggaggacggcuuccucgacgucuggaccuacaacgccgagcuccucguccuccucgagaacgagcgcacccucgaccuccacgacgccaacgucaagaaccuccacgagaaggucaagucccagcuccgcgacaacgccaacgaccucggcaacggcugcuucgaguucuggcacaagugcgacaacgagugcauggaguccgucaagaacggcaccuacgacuaccccaaguaccagaaggagucccgccucaaccgccagcgcaucgaguccgucaagcucgagaacuucgacgucuaccagauccucgccaucuacuccaccgucuccuccucccucgucgucgucggccucaucauggccaugggccucuggaugugcuccaacggcuccaugcagugcaugaucugcaucuga

SEQ ID NO: 102627 - RNA, 1701 nt, Artificial Sequence
  derived and/or modified sequence opt2 from hemagglutinin__InfluenzaA__AHJ57920
augaucgccaucaucaucaucgccauccucgucgccaccggcaaguccgacaagaucugcaucggcuaccacgccaacaacuccaccaccaaggucgacaccauccucgagaagaacgucaccgucacccacuccgucgagcuccucgagaaccagaaggaggagcgcuucugcaagaucuccaacaaggccccccucgaccuccgcgacugcaccaucgagggcuggauccucggcaaccccuggugcggcauccuccucgccgaccaguccugguccuacaucgucgagcgccccaacgcccgcaacggcaucugcuaccccggcacccucaacgaggucgaggagcucaaggcccucaucggcuccggcgagcgcgucgagcgcuucgagauguuccccaaguccaccugggccggcgucgacaccaacuccggcgucuccuccgccugcccccucggcaacggccccuccuucuaccgcaaccuccucuggaucaucaagaccaaguccuccgaguaccccgucaucaagggcaccuucaacaacaccggcgacaaguccguccucuacuucuggggcguccaccacccccccucccgcaacgagcagaacguccucuacggcuccggcgaccgcuacguccgcaugggcaccgaguccaugaacuucgcccgcucccccgagaucgccgcccgccccgccgucaacggccagcgcggccgcaucgacuacuucugguccauccucaagcccggcgagacccucaacgucgaguccaacggcaaccucaucgcccccugguacgccuaccgcuucgucaacaaggacucccgcggcgccaucuuccgcuccaaccuccccaucgagaacugcgacgccaccugccagaccgccgagggcgucauccgcaccaacaagaccuuccagaacgucuccccccucuggaucggcgagugccccaaguacgucaaguccaagucccuccgccucgccaccggccuccgcaacgucccccagaucgagacccgcggccucuucggcgccaucgccggcuucaucgagggcggcuggaccggcaugaucgacggcugguacggcuaccaccacgagaacucccagggcuccggcuacgccgccgaccgcgaguccacccagaaggccaccgacggcaucaccaacaaggucaacuccaucaucgacaagaugaacacccaguucgaggccgucggccacgaguucuccaaccucgagcgccgcaucgacaaccucaacaagcgcauggaggacggcuuccucgacgucuggaccuacaacgccgagcuccucguccuccucgagaacgagcgcacccucgaccuccacgacgccaacgucaagaaccuccacgagcgcgucaagucccagcuccgcgacaacgccaacgaccucggcaacggcugcuucgaguucuggcacaagugcgacaacgagugcauggaguccgucaagaacgacaccuacgacuaccccaaguaccagaaggagucccgccucaaccgccagaagaucgaguccguccgccucgagaacuucgacgucuaccagauccucgccaucuacuccaccgucuccuccucccucguccucgucggccucaucauggccaugggccucuggaugugcuccaacggcuccaugcagugccgcaucugcaucuga

SEQ ID NO: 102628 - RNA, 1701 nt, Artificial Sequence
  derived and/or modified sequence opt2 from hemagglutinin__InfluenzaA__AHJ57932
augaucgcccucaucaucaucaccauccucgucaccaccggcaaguccgacaagaucugcaucggcuaccacgccaacaacuccaccaccaaggucgacaccauccucgagaagaacgucaccgucacccacuccgucgagcuccucgagaaccagaaggaggagcgcuucugccgcaucuccaacaaggccccccucgaccucaaggagugcacccucgagggcuggauccucggcaacccccagugcgaccuccuccucggcgaccaguccugguccuacaucgucgagcgccccaacgcccgcaacggcaucugcuaccccggcacccucaacgaggucgaggagcuccgcgcccucaucggcuccggcgagggcgucgagcgcuucgagauguuccccaaguccaccugggccggcgucgacaccaaccgcggcgucaccuccuccugccccuucggcuccggcuccuccuucuaccgcaaccuccucuggaucgucaagcacaccaccuccuccuaccccgucaucaagggcaccuuccgcaacaccggcgacaaguccguccucuacuucuggggcguccaccaccccuucgacaccaacgagcagaacguccucuacggcuccggcaaccgcuacguccgcaugggcaccgaguccaugaacuucgcccgcggccccgaggucgccgcccgccccgucgucaacggccagcgcggccgcaucgacuacuucugguccauccucaagcccggcgagacccucaacaucgaguccaacggcaaccucaucgcccccugguacgccuaccgcuucgucaacaaggacuccaagggcgccaucuuccgcuccaaccuccccaucgaggacugcgacgccaccugccagaccaucgagggcgucauccgcaccaacaagaccuuccagaacgucuccccccucuggaucggcgagugccccaaguacgucaaguccgagucccuccgccucgccaccggccuccgcaacgucccccagaucgagacccgcggccucuucggcgccaucgccggcuucaucgagggcggcuggaccggcaugaucgacggcugguacggcuaccaccacgagaacucccagggcuccggcuacgccgccgaccgcgaguccacccagaaggccaucgacggcaucaccaccaaggucaacuccaucaucgacaagaugaacacccaguucgaggccgucggccacgaguucuccaaccucgagcgccgcaucgacaaccucaacaagcgccucgaggacggcuuccucgacgucuggaccuacaacgccgagcuccucguccuccucgagaacgagcgcacccucgaccuccacgacgccaacgucaagaaccuccacgagcgcguccgcucccagcuccgcgacaacgccaacgaccucggcaacggcugcuucgaguucuggcacaagugcgacaacgagugcauggaguccguccgcaacggcaccuacaacuaccccaaguaccaggccgagucccgccucaacaagcagcgcaucgaguccgucaagcucgagaacuucgacgucuaccagauccucgccaucuacuccaccgucuccuccucccucguccucgucggccucauccucgccaugggccucuggaugugcuccaacggcuccaugcagugccgcaucugcaucuga

SEQ ID NO: 102629 - RNA, 1701 nt, Artificial Sequence
  derived and/or modified sequence opt2 from hemagglutinin__InfluenzaA__AHJ57943
augaucgccuucaucgucaucgccacccucgucgccaccggcaaguccgacaagaucugcaucggcuaccacgccaacaacuccaccaccaaggucgacaccauccucgagaagaacgucaccgucacccacuccgucgagcuccucgagaaccagaaggaggagcgcuucugcaagaucuccaacaaggccccccucgaccuccgcgacugcacccucgagggcuggauccucggcaacccccgcugcggcauccuccucgccgaccaguccugguccuacaucgucgagcgccccaacgcccgcaacggcaucugcuaccccggcacccucaacgaggccgaggagcucaaggcccucaucggcuccggcgagcgcgucgagcgcuucgagauguuccccaaguccaccuggaccggcgucgacaccgaguccggcgucuccuccgccugcccccucggcaacggccccuccuucuaccgcaaccuccucuggaucaucaagcucaaguccuccgaguaccccgucauccgcggcaccuucaacaacaccggcgacaaguccauccucuacuucuggggcguccaccacccccccgucaccaccgagcagaacgcccucuacggcuccggcgaccgcuacguccgcaugggcaccgaguccaugaacuucgcccgcucccccgagaucgccgcccgccccgccgucaacggccagcgcggccgcaucgacuacuucugguccauccucaagcccggcgagacccucaacgucgaguccaacggcaaccucaucgcccccugguacgccuaccgcuucgucaacaaggacuccaagggcgccaucuuccgcuccaaccuccccaucgagaacugcgacgccaccugccagaccaccgagggcgucauccgcaccaacaagaccuuccagaacgucuccccccucuggaucggcgagugccccaaguacgucaaguccaagucccuccgccucgccaccggccuccgcaacgucccccagaucgagacccgcggccucuucggcgccaucgccggcuucaucgagggcggcuggaccggcaugaucgacggcugguacggcuaccaccacgagaacucccagggcuccggcuacgccgccgacaaggaguccacccagaaggccaucgacggcaucaccaacaaggucaacuccaucaucgacaagaugaacacccaguucgagaccgucggccacgaguucuccaaccucgagcgccgcaucgacaaccucaacaagcgcauggaggacggcuuccucgacgucuggaccuacaacgccgagcuccucguccuccucgagaacgagcgcacccucgaccuccacgacgccaacgucaagaaccuccacgagaagguccgcucccagcuccgcgacaacgccaacgaccucggcaacggcugcuucgaguucuggcacaagugcaacaacgagugcauggaguccgucaagaacggcaccuacgacuaccccaaguaccagaaggagucccgccucaaccgccagaagaucgaguccgucaagcucgagaacuucgacgucuaccagauccucgccaucuacuccaccgucuccuccucccucguccucgucggccucauccucgccaugggccucuggaugugcuccaacggcuccaugcagugccgcaucugcaucuga

SEQ ID NO: 102630 - RNA, 1701 nt, Artificial Sequence
  derived and/or modified sequence opt2 from hemagglutinin__InfluenzaA__AHJ57954
augaucgccuucaucgucaucgccauccucgccgccaccggcaaguccgacaagaucugcaucggcuaccacgccaacaacuccaccaccaaggucgacaccauccucgagaagaacgucaccgucacccacuccgucgagcuccucgagaaccagaaggaggagcgcuucugcaagaucuccaacaaggccccccucgaccuccgcgacugcacccucgagggcuggauccucggcaacccccgcugcggcauccuccucgccgaccaguccugguccuacaucgucgagcgccccaacgcccgcaacggcaucugcuaccccggcauccucaacgaggccgaggagcucaaggcccucaucggcuccggcgagcgcgucgagcgcuucgagauguuccccaaguccaccugggccggcgucgacaccaacuccggcgucuccuccgccugcccccucggcaacggccccuccuucuaccgcaaccuccucuggaucaucaagcagaaguccuccgccuaccccgucauccgcggcaccuucaacaacaccggcgacaaguccauccucuacuucuggggcguccaccacccccccgucaccaccgagcaggaggcccucuacggcuccggcaaccgcuacguccgcaugggcaccgaguccaugaacuucgcccgcaaccccgagaucgccgcccgccccgccgucaacggccagcgcggccgcaucgacuacuucugguccauccucaagcccggcgagacccucaacgucgaguccaacggcaaccucaucgcccccugguacgccuaccgcuucgucaacaaggacuccaagggcgccaucuuccgcuccaaccuccccaucgagaacugcgacgccaccugccagaccaccgagggcgucauccgcaccaacaagaccuuccagaacgucuccccccucuggaucggcgagugccccaaguacgucaaguccaagucccuccgccucgccaccggccuccgcaacgucccccagaucgagacccgcggccucuucggcgccaucgccggcuucaucgagggcggcuggaccggcaugaucgacggcugguacggcuaccaccacgagaacucccagggcuccggcuacgccgccgaccgcgaguccacccagaaggccaucgacggcaucaccaacaaggucaacuccaucaucgacaagaugaacacccaguucgaggccgucggccacgaguucuccaaccucgagcgccgcaucgacaaccucaacaagcgcauggaggacggcuuccucgacgucuggaccuacaacgccgagcuccucguccuccucgagaacgagcgcacccucgaccuccacgacgccaacgucaagaaccuccacgagaagguccgcucccagcuccgcgacaacgccaacgaccucggcaacggcugcuucgaguucuggcacaagugcgacaacgagugcauggaguccgucaagaacggcaccuacgacuaccccaaguaccaggccgagucccgccucaaccgccagaagaucgaguccgucaagcucgagaacuucgacgucuaccagauccucgccaucuacuccaccgucuccuccucccucguccucgucggccucaucauggccaugggccucuggaugugcuccaacggcuccaugcagugccgcaucugcaucuga

SEQ ID NO: 102631 - RNA, 1701 nt, Artificial Sequence
  derived and/or modified sequence opt2 from hemagglutinin__InfluenzaA__AHJ57965
augaucgccuucaucaucaucaccauccucgucaccaccggcaaguccgacaagaucugcaucggcuaccacgccaacaacuccaccaccaaggucgacaccauccucgagaagaacgucaccgucacccacuccgucgagcuccucgagaaccagaaggaggagcgcuucugcaagaucuccaacaaggccccccucgaccucaaggagugcacccucgagggcuggauccucggcaacccccagugcgaccuccuccucggcgaccaguccugguccuacaucgucgagcgccccaacgcccgcaacggcaucugcuaccccggcacccucaacgaggucgaggagcucaaggcccucaucggcuccggcgagcgcgucgagcgcuucgagauguuccccaaguccaccugggccggcgucgacaccaacuccggcgucaccuccuccugcuccuucggcuccggcuccuccuucuaccgcaaccuccucuggaucaucaagcacaccaccuccuccuaccccgucaucaagggcaccuuccgcaacaccggcgacaaguccguccucuacuucuggggcguccaccaccccaucgacaccaccgagcagaacguccucuacggcuccggcaaccgcuacguccgcaugggcaccgaguccaugaacuucgcccgcucccccgagaucgccgcccgccccgucgucaacggccagcgcggccgcaucgacuacuucugguccauccucaagcccggcgagacccucaacaucgaguccaacggcaaccucaucgcccccugguacgccuaccgcuucgucaacaaggacuccaagggcgccaucuuccgcuccaaccuccccaucgagaacugcgacgccaccugccagaccaucgagggcgucauccgcaccaacaagaccuuccagaacgucuccccccucuggaucggcgagugccccaaguacgucaaguccgagucccuccgccucgccaccggccuccgcaacgucccccagaucgagacccgcggccucuucggcgccaucgccggcuucaucgagggcggcuggaccggcaugaucgacggcugguacggcuaccaccacgagaacucccagggcuccggcuacgccgccgaccgcgaguccacccagcgcgccaucgacggcaucaccaccaaggucaacuccaucaucgacaagaugaacacccaguucgaggccgucggccacgaguucuccaaccucgagcgccgcaucgacaaccucaacaagcgcauggaggacggcuuccucgacgucuggaccuacaacgccgagcuccucguccuccucgagaacgagcgcacccucgaccuccacgacgccaacgucaagaaccuccacgagcgcguccgcucccagcuccgcgacaacgccaacgacggcggcaacggcugcuucgaguucuggcacaagugcgacaacgagugcauggaguccgucaagaacggcaccuacgacuaccccaaguaccaggccgagucccgcuccaaccgccagcgcaucgaguccgucaagcucgagaacuucgacgucuaccagauccucgccaucuacuccaccgucuccuccucccucgucgucgucuggcucauccucgccaugggccucuggaugugcgccaacggcuccaugcagugccgcaucugcaucuga

SEQ ID NO: 102632 - RNA, 1701 nt, Artificial Sequence
  derived and/or modified sequence opt2 from hemagglutinin__InfluenzaA__AHJ57977
augaucgccuucaucgucaucgccauccucgccgccaccggcaaguccgacaagaucugcaucggcuaccacgccaacaacuccaccaccaaggucgacaccauccucgagaagaacgucaccgucacccacuccgucgagcuccucgagaaccagaaggaggagcgcuucugcaagaucuccaacaaggccccccucgaccuccgcgacugcaccaucgagggcuggauccucggcaacccccgcugcggcauccuccucgccgaccaguccugguccuacaucgucgagcgccccaacgcccgcaacggcaucugcuaccccggcacccucaacgaggucgaggagcucaaggcccucaucggcuccggcgagcgcgucgagcgcuucgagauguuccccaaguccaccugggccggcgucgacaccaacuccggcgucuccuccgccugcccccucggcaacggccccuccuucuaccgcaaccuccucuggaucaucaagcucaaguccuccgaguaccccgucauccgcggcaccuucaacaacaccggcgacaaguccauccucuacuucuggggcguccaccacccccccgucaccaccgagcaggaggcccucuacggcuccggcgaccgcuacguccgcaugggcaccgaguccaugaacuucgcccgcucccccgagaucgccgcccgccccgccgucaacggccagcgcggccgcaucgacuacuucugguccauccucaagcccggcgagacccucaacgucgaguccaacggcaaccucaucgcccccugguacgccuaccgcuucgucaacaaggacuccaagggcgccaucuuccgcuccaaccuccccaucgagaacugcgacgccaccugccagaccaccgagggcgucauccgcaccaacaagaccuuccagaacgucuccccccucuggaucggcgagugccccaaguacgucaaguccaagucccuccgccucgccaccggccuccgcaacgucccccagaucgagacccgcggccucuucggcgccaucgccggcuucaucgagggcggcuggaccggcaugaucgacggcugguacggcuaccaccacgagaacucccagggcuccggcuacgccgccgacaaggaguccacccagaaggccaucgacggcaucaccaacaaggucaacuccaucaucgacaagaugaacacccaguucgaggccgucggccacgaguucuccaaccucgagcgccgcaucgacaaccucaacaagcgcauggaggacggcuuccucgacgucuggaccuacaacgccgagcuccucguccuccucgagaacgagcgcacccucgaccuccacgacgccaacgucaagaaccuccacgagaagguccgcucccagcuccgcgacaacgccaacgaccucggcaacggcugcuucgaguucuggcacaagugcaacaacgagugcauggaguccgucaagaacggcaccuacgacuaccccaaguaccagaaggagucccgccucaaccgccagaagaucgaguccgucaagcucgagaacuucgacgucuaccagauccucgccaucuacuccaccgucuccuccucccucguccucgucggccucauccucgccaugggccucuggaugugcuccaacggcuccaugcagugccgcaucugcaucuga

SEQ ID NO: 102633 - RNA, 1701 nt, Artificial Sequence
  derived and/or modified sequence opt2 from hemagglutinin__InfluenzaA__AHJ57989
augaucgccuucaucgucaucgccauccucgucaccaccggcaaguccgacaagaucugcaucggcuaccacgccaacaacuccaccaccaaggucgacaccauccucgagaagaacgucaccgucacccacuccgucgagcuccucgagaaccagaaggaggagcgcuucugcaagaucuccaacaaggccccccucgaccuccgcgacugcacccucgagggcuggauccucggcaacccccgcugcggcauccuccucgccgaccaguccugguccuacaucgucgagcgccccaacgcccgcaacggcaucugcuaccccggcacccucaacgaggucgaggagcucaaggcccucaucggcuccggcgagcgcgucgagcgcuucgagauguuccccaaguccaccugggcccgcgucgacaccgaccgcggcgucuccuccgccugcccccucggcaacggccccuccuucuaccgcaaccuccucuggaucgucaagcacaccaccuccgaguaccccgucaucaagggcaccuacaccaacaccggcgacaaguccguccucuacuucuggggcguccaccacccccccgacaccaccgagcagaacguccucuacggcuccggcaaccgcuacguccgcaugggcaccgaguccaugaacuucgcccgcucccccgagaucgccgcccgccccgccgucaacggccagcgcggccgcaucgacuacuucugguccauccucaagcccggcgagacccucaacgucgaguccaacggcaaccucaucgcccccugguacgccuaccgcuucgucaacaaggacuccaagggcgccaucuuccgcuccaaccuccccaucgagaacugcgacgccaccugccagaccaccgagggcgucauccgcaccaacaagaccuuccagaacgucucccccauguggaucggcgagugccccaaguacgucaaguccaagucccuccgccucgccaccggccuccgcaacgucccccagaucgagacccgcggccucuucggcgccaucgccggcuucaucgagggcggcuggaccggcaugaucgacggcugguacggcuaccaccacgagaacucccagggcuccggcuacgccgccgaccgcgaguccacccagaaggccaucgacggcaucaccaacaaggucaacuccaucaucgacaagaugaacacccaguucgaggccgucggccacgaguucuccaaccucgagcgccgcaucgacaaccucaacaagcgcauggaggacggcuuccucgacgucuggaccuacaacgccgagcuccucguccuccucgagaacgagcgcacccucgaccuccacgacuccaacgucaagaaccuccacgagcgcgucaagucccagcuccgcgacaacgccaacgaccucggcaacggcugcuucgaguucuggcacaagugcgacaacgagugcauggaguccgucaagaacggcaccuacaacuaccccaaguaccaggccgagucccgccucaaccgccagaagaucgaguccgucaagcucgaggaguucggcgucuaccagauccucgccaucuacuccaccgucuccuccucccucguccucgucggccucaucauggccaugggccucuggaugugcuccaacggcuccaugcagugccgcaucugcaucuga

SEQ ID NO: 102634 - RNA, 1701 nt, Artificial Sequence
  derived and/or modified sequence opt2 from hemagglutinin__InfluenzaA__AHJ58001
augaucgccuucaucgucaucgccauccucgccgccaccggcaaguccgacaagaucugcaucggcuaccacgccaacaacuccaccaccaaggucgacaccauccucgagaagaacgucaccgucacccacuccgucgagcuccucgagaaccagaaggaggagcgcuucugcaagaucuccaacaaggccccccucgaccuccgcgacugcacccucgagggcuggauccucggcaacccccgcugcggcauccuccucgccgaccaguccugguccuacaucgucgagcgccccaacgcccgcaacggcaucugcuaccccggcauccucaacgaggccgaggagcucaaggcccucaucggcuccggcgagcgcgucgagcgcuucgagauguuccccaaguccaccugggccggcgucgacaccgacuccggcgucuccuccgccugcccccucggcaacggccccuccuucuaccgcaaccuccucuggaucaucaagcucaaguccuccgaguaccccgucauccgcggcaccuucaacaacaccggcgacaaguccauccucuacuucuggggcguccaccacccccccgucaccaccgagcaggaggcccucuacggcuccggcaaccgcuacguccgcaugggcaccgaguccaugaacuucgcccgcucccccgagaucgccgcccgccccgccgucaacggccagcgcggccgcaucgacuacuucugguccauccucaagcccggcgagacccucaacgucgaguccaacggcaaccucaucgcccccugguacgccuaccgcuucgucaacaaggacuccaagggcgccaucuuccgcuccaaccuccccaucgagaacugcgacgccaccugccagaccaccgagggcgucauccgcaccaacaagaccuuccagaacgucucccccauguggaucggcgagugccccaaguacgucaaguccaagucccuccgccucgccaccggccuccgcaacgucccccagaucgagacccgcggccucuucggcgccaucgccggcuucaucgagggcggcuggaccggcaugaucgacggcugguacggcuaccaccacgagaacucccagggcuccggcuacgccgccgaccgcgaguccacccagaaggccaucgacggcaucaccaacaaggucaacuccaucaucgacaagaugaacacccaguucgaggccgucggccacgaguucuccaaccucgagcgccgcaucgacaaccucaacaagcgcauggaggacggcuuccucgacgucuggaccuacaacgccgagcuccucguccuccucgagaacgagcgcacccucgaccuccacgacgccaacgucaagaaccuccacgagaagguccgcucccagcuccgcgacaacgccaacgaccucggcaacggcugcuucgaguucuggcacaagugcgacaacgagugcauggaguccgucaagaacggcaccuacgacuaccccaaguaccagaccgagucccgccucaaccgccagaagaucgaguccgucaagcucgagaacuucgacgucuaccagauccucgccaucuacuccaccgucuccuccucccucguccucgucggccucaucauggccaugggccucuggaugugcuccaacggcuccaugcagugccgcaucugcaucuga

SEQ ID NO: 102635 - RNA, 1701 nt, Artificial Sequence
  derived and/or modified sequence opt2 from hemagglutinin__InfluenzaA__AHJ58013
augaucgccuucaucgucaucgccauccucgucaccaccggcaaguccgacaagaucugcaucggcuaccacgccaacaacuccaccaccaaggucgacaccauccucgagaagaacgucaccgucacccacuccgucgagcuccucgagaaccagaaggaggagcgcuucugcaagaucuccuccaaggccccccucgaccuccgcgacugcucccucgagggcuggauccucggcaacccccgcugcggcauccuccucgccgaccaguccugguccuacaucgucgagcgccccaacgcccgcaacggcaucugcuaccccggcacccucaacgaggucgaggagcucaaggcccucaucggcuccggcgagcgcgucgagcgcuucgagauguuccccaaguccaccugggccggcgucgacaccaacuccggcgucuccuccgccugcccccucggcgagggccccuccuucuaccgcaaccuccucuggaucaucaagcgcaccaccuccgaguaccccgucaucaagggcaccuaccgcaacaccggcgacaaguccguccucuacuucuggggcguccaccacccccccgacaccaccgagcagaacguccucuacggcuccggcaaccgcuacguccgcaugggcaccgaguccaugaacuucgcccgcucccccgagaucgccgcccgccccgccgucaacggccagcgcggccgcaucgacuacuucugguccauccucaagcccggcgagacccucgacgucgaguccaacggcaaccucaucgcccccugguacgccuaccgcuucgucaacaaggaguccaagggcgccaucuuccgcuccaaccuccccaucgagaacugcgacgccaccugccagaccaccgagggcgucauccgcaccaacaagaccuuccagaacgucuccccccucuggaucggcgagugccccaaguacgucaaguccaagucccuccgccucgccaccggccuccgcaacgucccccagaucgagacccgcggccucuucggcgccaucgccggcuucaucgagggcggcuggaccggcaugaucgacggcugguacggcuaccaccacgagaacucccagggcuccggcuacgccgccgacaaggaguccacccagaaggccaucgacggcaucaccaacaaggucaacuccaucaucgacaagaugaacacccaguucgaggccgucggccacgaguucuccacccucgagcgccgcaucgacaaccucaacaagcgcauggaggacggcuuccucgacgucuggaccuacaacgccgagcuccucguccuccucgagaacgagcgcacccucgaccuccacgacgccaacgucaagaaccuccacgagcgcguccgcucccagcuccgcgacaacgccaacgaccucggcaacggcugcuucgaguucuggcacaagugcgacaacgagugcauggaguccgucaagaacggcaccuacaacuaccccaaguaccaggccgagucccgccucaacaagcagaagaucgaguccgucaagcucgaggaguucggcgucuaccagauccucgccaucuacuccaccgucuccuccucccucguccucgucggccucaucauggccaugggccucuggaugugcuccaacggcuccaugcagugccgcaucugcaucuga

SEQ ID NO: 102636 - RNA, 1701 nt, Artificial Sequence
  derived and/or modified sequence opt2 from hemagglutinin__InfluenzaA__AHJ58025
augaucgccuucaucgucaucgccauccucgucaccaccggcgaguccgacaagaucugcaucggcuaccacgccaacaacuccaccaccaaggucgacaccauccucgagaagaacgucaccgucacccacuccgucgagcuccucgagaaccagaaggaggagcgcuucugcaagaucuccaacaaggccccccucgaccuccgcgacugcaccaucgagggcuggauccucggcaacccccgcugcggcauccuccucgccgaccaguccugguccuacaucgucgagcgccccaacgcccgcaacggcaucugcuaccccggcacccucaacgaggccgaggagcucaaggcccucaucggcuccggcgagggcgucgagcgcuucgagauguuccccaaguccaccugggccggcgucgacaccaacuccggcgucuccuccgccugcccccucggcaacggccccuccuucuaccgcaaccuccucuggaucaucaagcucaaguccuccgaguaccccgucauccgcggcaccuucaacaacaccggcgacaaguccguccucuacuucuggggcguccaccacccccccgucaccaccgagcagaacgaccucuacggcuccggcaaccgcuacguccgcaugggcaccgaguccaugaacuucgcccgcaaccccgagaucgcccuccgccccgccgucaacggccagcgcggccgcaucgacuacuucugguccauccucaagcccggcgagacccucaacgucgaguccaacggcaaccucaucgcccccugguacgccuaccgcuucgucaacaaggacuccaagggcgccaucuuccgcuccucccuccccaucgagaacugcgacgccaccugccagaccgccgagggcgucauccgcaccaacaagaccuuccagaacgucuccccccucuggaucggcgagugccccaaguacgucaaguccaagucccuccgccucgccaccggccuccgcaacgucccccagaucgagacccgcggccucuucggcgccaucgccggcuucaucgagggcggcuggaccggcauggucgacggcugguacggcuaccaccacgagaacucccagggcuccggcuacgccgccgaccgcgaguccacccagaaggccaucgacggcaucaccaacaaggucaacuccaucaucgacaagaugaacacccaguucgaggccgucgaccacgaguucuccaaccucgagcgccgcaucgacaaccucaacaagcgcauggaggacggcuuccucgacgucuggaccuacaacgccgagcuccucguccuccucgagaacgagcgcacccucgaccuccacgacgccaacgucaagaaccuccacgagaaggucaagucccagcuccgcgacaacgccaacgaccucggcaacggcugcuucgaguucuggcacaagugcgacaacgagugcauggaguccgucaagaacggcaccuacaacuaccccaaguaccagaaggagucccgccucaaccgccagaagaucgaguccgucaagcucgagaacuucgacgucuaccagauccucgccaucuacuccaccgucuccuccucccucguccucgucggccucaucauggccaugggccucuggaugugcuccaacggcuccaugcagugccgcaucugcaucuga

SEQ ID NO: 102637 - RNA, 1701 nt, Artificial Sequence
  derived and/or modified sequence opt2 from hemagglutinin__InfluenzaA__AHJ58037
augaucgccuucaucaucaucaccauccucgucaccaccggcgaguccgacaagaucugcaucggcuaccacgccaacaacuccaccaccaaggucgacaccauccucgagaagaacgucaccgucacccacuccgucgagcuccucgagaaccagaaggaggagcgcuucugcaagaucuccaacaaggccccccucgaccucaaggagugcacccucgagggcuggauccucggcaacccccagugcgaccuccuccucggcgaccaguccugguccuacaucgucgagcgccccaacgcccgcaacggcaucugcuaccccggcacccucaacgaggucgaggagcucaaggcccucaucggcuccggcgagcgcgucgagcgcuucgagauguuccccaaguccaccugggccggcgucgacaccaacuccggcgucacccgcuccugccccuucggcuccggcuccuccuucuaccgcaaccuccucuggaucaucaagcacaccaccuccuccuaccccgucaucaagggcaccuuccgcaacaccggcgacaaguccguccucuacuucuggggcguccaccaccccaucgacaccaccgagcagaacguccucuacggcuccggcaaccgcuacguccgcaugggcaccgaguccaugaacuucgcccgcucccccgagaucgccgcccgccccgucgucaacggccagcgcggccgcaucgacuacuucugguccauccucaagcccggcgagacccucaacaucgaguccaacggcaaccucaucgcccccugguacgccuaccgcuucgucaacaaggacuccaagggcgccaucuuccgcuccaaccuccccaucgagaacugcgacgccaccugccagaccaucgagggcgucauccgcaccaacaagaccuuccagaacgucuccccccucuggaucggcgagugccccaaguacgucaaguccgagucccuccgccucgccaccggccuccgcaacgucccccagaucgagacccgcggccucuucggcgccaucgccggcuucaucgagggcggcuggaccggcaugaucgacggcugguacggcuaccaccacgagaacucccagggcuccggcuacgccgccgaccgcgaguccacccagcgcgccaucgacggcaucaccaccaaggucaacuccaucaucgacaagaugaacacccaguucgaggccgucggccacgaguucuccaaccucgagcgccgcaucgacaaccucaacaagcgcauggaggacggcuuccucgacgucuggaccuacaacgccgagcuccucguccuccucgagaacgagcgcacccucgaccuccacgacgccaacgucaagaaccuccacgagcgcgucaagucccagcuccgcgacaacgccaacgaccucggcaacggcugcuucgaguucuggcacaagugcgacaacgagugcauggaguccgucaagaacggcaccuacgacuaccccaaguaccaggccgagucccgccucaacaagcagcgcaucgaguccgucaagcucgagaacuucgacgucuaccagauccucgccaucuacuccaccgucuccuccucccucguccucgucggccucaucauggccaucggccucuggaugugcuccaacggcuccaugcagugccgcaucugcaucuga

SEQ ID NO: 102638 - RNA, 1701 nt, Artificial Sequence
  derived and/or modified sequence opt2 from hemagglutinin__InfluenzaA__AHJ58049
augaucgccuucaucgucaucgccauccucgccgccaccggcaaguccgacaagaucugcaucggcuaccacgccaacaacuccaccaccaaggucgacaccauccucgagaagaacgucaccgucacccacuccgucgagcuccucgagaaccagaaggaggagcgcuucugcaagaucuccaacaaggccccccucgaccuccgcgacugcacccucgagggcuggauccucggcaacccccgcugcggcauccuccucgccgaccaguccugguccuacaucgucgagcgccccaacgcccgcaacggcaucugcuaccccggcauccucaacgaggccgaggagcucaaggcccucaucggcuccggcgagcgcgucgagcgcuucgagauguuccccaaguccaccugggccggcgucgacaccgacuccggcgucuccuccgccugcccccucggcaacggccccuccuucuaccgcaaccuccucuggaucaucaagcucaaguccuccgaguaccccgucauccgcggcaccuucaacaacaccggcgacaaguccauccucuacuucuggggcguccaccacccccccgucaccaccgagcaggaggcccucuacggcuccggcaaccgcuacguccgcaugggcaccgaguccaugaacuucgcccgcacccccgagaucgccgcccgccccgccgucaacggccagcgcggccgcaucgacuacuucugguccauccucaagcccggcgagacccucaacgucgaguccaacggcaaccucaucgcccccugguacgccuaccgcuucgucaacaaggacuccaagggcgccaucuuccgcuccaaccuccccaucgagaacugcgacgccaccugccagaccaccgagggcgucauccgcaccaacaagaccuuccagaacgucuccccccucuggaucggcgagugccccaaguacgucaaguccaagucccuccgccucgccaccggccuccgcaacgucccccagaucgagacccgcggccucuucggcgccaucgccggcuucaucgagggcggcuggaccggcaugaucgacggcugguacggcuaccaccacgagaacucccagggcuccggcuacgccgccgaccgcgaguccacccagaaggccaucgacggcaucaccaacaaggucaacuccaucaucgacaagaugaacacccaguucgaggccgucggccacgaguucuccaaccucgagcgccgcaucgacaaccucaacaagcgcauggaggacggcuuccucgacgucuggaccuacaacgccgagcuccucguccuccucgagaacgagcgcacccucgaccuccacgacgccaacgucaagaaccuccacgagaagguccgcucccagcuccgcgacaacgccaacgaccucggcaacggcugcuucgaguucuggcacaagugcgacaacgagugcauggaguccgucaagaacggcaccuacgacuaccccaaguaccaggccgagucccgccucaaccgccagaagaucgaguccgucaagcucgagaacuucgacgucuaccagauccucgccaucuacuccaccgucuccuccucccucguccucgucggccucaucauggccaugggccucuggaugugcuccaacggcuccaugcagugccgcaucugcaucuga

SEQ ID NO: 102639 - RNA, 1701 nt, Artificial Sequence
  derived and/or modified sequence opt2 from hemagglutinin__InfluenzaA__AHJ58061
augaucgccuucaucgucaucgccacccucgucgccaccggcaaguccgacaagaucugcaucggcuaccacgccaacaacuccaccaccaaggucgacaccauccucgagaagaacgucaccgucacccacuccgucgagcuccucgagaaccagaaggaggagcgcuucugcaagaucuccaacaaggccccccucgaccuccgcgacugcacccucgagggcuggauccucggcaacccccgcugcggcauccuccucgccgaccaguccugguccuacaucgucgagcgccccaacgcccgcaacggcaucugcuaccccggcacccucaacgaggccgaggagcucaaggcccucaucggcuccggcgagcgcgucgagcgcuucgagauguuccccaaguccaccuggaccggcgucgacaccgaguccggcgucuccuccgccugcccccucggcaacggccccuccuucuaccgcaaccuccucuggaucaucaagcucaaguccuccgaguaccccgucauccgcggcaccuucaacaacaccggcgacaaguccauccucuacuucuggggcguccaccacccccccgucaccaccgagcagaacgcccucuacggcuccggcgaccgcuacguccgcaugggcaccgaguccaugaacuucgcccgcucccccgagaucgccgcccgccccgccgucaacggccagcgcggccgcaucgacuacuucugguccauccucaagcccggcgagacccucaacgucgaguccaacggcaaccucaucgcccccugguacgccuaccgcuucgucaacaaggacuccaagggcgccaucuuccgcuccaaccuccccaucgagaacugcgacgccaccugccagaccaccgagggcgucauccgcaccaacaagaccuuccagaacgucuccccccucuggaucggcgagugccccaaguacgucaaguccaagucccuccgccucgccaccggccuccgcaacgucccccagaucgagacccgcggccucuucggcgccaucgccggcuucaucgagggcggcuggaccggcaugaucgacggcugguacggcuaccaccacgagaacucccagggcuccggcuacgccgccgacaaggaguccacccagaaggccaucgacggcaucaccaacaaggucaacuccaucaucgacaagaugaacacccaguucgaggccgucggccacgaguucuccaaccucgagcgccgcaucgacaaccucaacaagcgcauggaggacggcuuccucgacgucuggaccuacaacgccgagcuccucguccuccucgagaacgagcgcacccucgaccuccacgacgccaacgucaagaaccuccacgagaagguccgcucccagcuccgcgacaacgccaacgaccucggcaacggcugcuucgaguucuggcacaagugcaacaacgagugcauggaguccgucaagaacggcaccuacgacuaccccaaguaccagaaggagucccgccucaaccgccagaagaucgaguccgucaagcucgagaacuucgacgucuaccagauccucgccaucuacuccaccgucuccuccucccucguccucgucggccucauccucgccaugggccucuggaugugcuccaacggcuccaugcagugccgcaucugcaucuga

SEQ ID NO: 102640 - RNA, 1701 nt, Artificial Sequence
  derived and/or modified sequence opt2 from hemagglutinin__InfluenzaA__AHJ58084
augaucgccuucaucgucaucgccacccucgucgccaccggcaaguccgacaagaucugcaucggcuaccacgccaacaacuccaccaccaaggucgacaccauccucgagaagaacgucaccgucacccacuccgucgagcuccucgagaaccagaaggaggagcgcuucugcaagaucuccaacaaggccccccucgaccuccgcgacugcacccucgagggcuggauccucggcaacccccgcugcggcauccuccucgccgaccaguccugguccuacaucgucgagcgccccaacgcccgcaacggcaucugcuaccccggcacccucaacgaggccgaggagcucaaggcccucaucggcuccggcgagcgcgucgagcgcuucgagauguuccccaaguccaccuggaccggcgucaacaccgaguccggcgucuccuccgccugcccccucggcaacggccccuccuucuaccgcaaccuccucuggaucaucaagcucaaguccuccgaguaccccgucauccgcggcaccuucaacaacaccggcgacaaguccauccucuacuucuggggcguccaccacccccccgucaccaccgagcagaacgcccucuacggcuccggcgaccgcuacguccgcaugggcaccgaguccaugaacuucgcccgcucccccgagaucgccgcccgccccgccgucaacggccagcgcggccgcaucgacuacuucugguccauccucaagcccggcgagacccucaacgucgaguccaacggcaaccucaucgcccccugguacgccuaccgcuucgucaacaaggacuccaagggcgccaucuuccgcuccaaccuccccaucgagaacugcgacgccaccugccagaccaccgagggcgucauccgcaccaacaagaccuuccagaacgucuccccccucuggaucggcgagugccccaaguacgucaaguccaagucccuccgccucgccaccggccuccgcaacgucccccagaucgagacccgcggccucuucggcgccaucgccggcuucaucgagggcggcuggaccggcaugaucgacggcugguacggcuaccaccacgagaacucccagggcuccggcuacgccgccgacaaggaguccacccagaaggccaucgacggcaucaccaacaaggucaacuccaucaucgacaagaugaacacccaguucgaggccgucggccacgaguucuccaaccucgagcgccgcaucgacaaccucaacaagcgcauggaggacggcuuccucgacgucuggaccuacaacgccgagcuccucguccuccucgagaacgagcgcacccucgaccuccacgacgccaacgucaagaaccuccacgagaagguccgcucccagcuccgcgacaacgccaacgaccucggcaacggcugcuucgaguucuggcacaagugcaacaacgagugcauggaguccgucaagaacggcaccuacgacuaccccaaguaccagaaggagucccgccucaaccgccagaagaucgaguccgucaagcucgagaacuucgacgucuaccagauccucgccaucuacuccaccgucuccuccucccucguccucgucggccucauccucgccaugggccucuggaugugcuccaacggcuccaugcagugccgcaucugcaucuga

SEQ ID NO: 102641 - RNA, 1701 nt, Artificial Sequence; identical to SEQ ID NO: 98367
  derived and/or modified sequence opt2 from hemagglutinin__InfluenzaA__AHL80708

SEQ ID NO: 102642 - RNA, 1701 nt, Artificial Sequence
  derived and/or modified sequence opt2 from hemagglutinin__InfluenzaA__AHL80718
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaucuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacaccuccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102643 - RNA, 1710 nt, Artificial Sequence
  derived and/or modified sequence opt2 from hemagglutinin__InfluenzaA__AHL80729
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcgagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccucaccucccuccccuuccagaacguccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102644 - RNA, 1701 nt, Artificial Sequence
  derived and/or modified sequence opt2 from hemagglutinin__InfluenzaA__AHL80740
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagcuccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcguccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102645 - RNA, 1701 nt, Artificial Sequence
  derived and/or modified sequence opt2 from hemagglutinin__InfluenzaA__AHL80751
augaaggccauccucgucguccuccucuacaccuucgccaccgccaacgccgacacccucugcaucggcuaccacgccaacaacuccaccgacaccgucgacaccauccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagauccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagaagaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggaggucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102646 - RNA, 1701 nt, Artificial Sequence
  derived and/or modified sequence opt2 from hemagglutinin__InfluenzaA__AHL80762
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggauccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaaggacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102647 - RNA, 1701 nt, Artificial Sequence
  derived and/or modified sequence opt2 from hemagglutinin__InfluenzaA__AHL80784
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcaucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102648 - RNA, 1701 nt, Artificial Sequence; identical to SEQ ID NO: 95345
  derived and/or modified sequence opt2 from hemagglutinin__InfluenzaA__AHL80795

SEQ ID NO: 102649 - RNA, 1701 nt, Artificial Sequence
  derived and/or modified sequence opt2 from hemagglutinin__InfluenzaA__AHL80817
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaacugcaacaucgccggcuggauccucggcaaccccgagugcgagucccucuccaccgccuccuccugguccuacaucgucgaggccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102650 - RNA, 1701 nt, Artificial Sequence; identical to SEQ ID NO: 102649
  derived and/or modified sequence opt2 from hemagglutinin__InfluenzaA__AHL80828

SEQ ID NO: 102651 - RNA, 1701 nt, Artificial Sequence
  derived and/or modified sequence opt2 from hemagglutinin__InfluenzaA__AHL80839
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcaucaccgccgccugcccccacgccggcgccaaguccuucuacaagaaccucaucuggcucgucaagaagggcaacuccuaccccaagcucucccgcuccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102652 - RNA, 1701 nt, Artificial Sequence
  derived and/or modified sequence opt2 from hemagglutinin__InfluenzaA__AHL80861
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucggcaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102653 - RNA, 1701 nt, Artificial Sequence
  derived and/or modified sequence opt2 from hemagglutinin__InfluenzaA__AHL80872
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaacgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102654 - RNA, 1701 nt, Artificial Sequence; identical to SEQ ID NO: 95345
  derived and/or modified sequence opt2 from hemagglutinin__InfluenzaA__AHL80883

SEQ ID NO: 102655 - RNA, 1701 nt, Artificial Sequence; identical to SEQ ID NO: 95345
  derived and/or modified sequence opt2 from hemagglutinin__InfluenzaA__AHL80894

SEQ ID NO: 102656 - RNA, 1701 nt, Artificial Sequence; identical to SEQ ID NO: 95345
  derived and/or modified sequence opt2 from hemagglutinin__InfluenzaA__AHL80905

SEQ ID NO: 102657 - RNA, 1701 nt, Artificial Sequence; identical to SEQ ID NO: 97966
  derived and/or modified sequence opt2 from hemagglutinin__InfluenzaA__AHL80916

SEQ ID NO: 102658 - RNA, 1701 nt, Artificial Sequence; identical to SEQ ID NO: 98367
  derived and/or modified sequence opt2 from hemagglutinin__InfluenzaA__AHL80927

SEQ ID NO: 102659 - RNA, 1701 nt, Artificial Sequence; identical to SEQ ID NO: 98367
  derived and/or modified sequence opt2 from hemagglutinin__InfluenzaA__AHL80946

SEQ ID NO: 102660 - RNA, 1701 nt, Artificial Sequence
  derived and/or modified sequence opt2 from hemagglutinin__InfluenzaA__AHL80958
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaucuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacaccuccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102661 - RNA, 1701 nt, Artificial Sequence
  derived and/or modified sequence opt2 from hemagglutinin__InfluenzaA__AHL81001
augaagaccaucaucgcccucuccuacauccucugccucaucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccgccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102662 - RNA, 1701 nt, Artificial Sequence; identical to SEQ ID NO: 98367
  derived and/or modified sequence opt2 from hemagglutinin__InfluenzaA__AHL81013

SEQ ID NO: 102663 - RNA, 1701 nt, Artificial Sequence; identical to SEQ ID NO: 98367
  derived and/or modified sequence opt2 from hemagglutinin__InfluenzaA__AHL81025

SEQ ID NO: 102664 - RNA, 1701 nt, Artificial Sequence; identical to SEQ ID NO: 98367
  derived and/or modified sequence opt2 from hemagglutinin__InfluenzaA__AHL81037

SEQ ID NO: 102665 - RNA, 1701 nt, Artificial Sequence; identical to SEQ ID NO: 98367
  derived and/or modified sequence opt2 from hemagglutinin__InfluenzaA__AHL81049

SEQ ID NO: 102666 - RNA, 1701 nt, Artificial Sequence; identical to SEQ ID NO: 102660
  derived and/or modified sequence opt2 from hemagglutinin__InfluenzaA__AHL81061

SEQ ID NO: 102667 - RNA, 1701 nt, Artificial Sequence; identical to SEQ ID NO: 102660
  derived and/or modified sequence opt2 from hemagglutinin__InfluenzaA__AHL81072

SEQ ID NO: 102668 - RNA, 1701 nt, Artificial Sequence; identical to SEQ ID NO: 99873
  derived and/or modified sequence opt2 from hemagglutinin__InfluenzaA__AHL81083

SEQ ID NO: 102669 - RNA, 1701 nt, Artificial Sequence; identical to SEQ ID NO: 98367
  derived and/or modified sequence opt2 from hemagglutinin__InfluenzaA__AHL81095

SEQ ID NO: 102670 - RNA, 1701 nt, Artificial Sequence
  derived and/or modified sequence opt2 from hemagglutinin__InfluenzaA__AHL81118
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccaacuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102671 - RNA, 1701 nt, Artificial Sequence; identical to SEQ ID NO: 98367
  derived and/or modified sequence opt2 from hemagglutinin__InfluenzaA__AHL81129

SEQ ID NO: 102672 - RNA, 1701 nt, Artificial Sequence; identical to SEQ ID NO: 98367
  derived and/or modified sequence opt2 from hemagglutinin__InfluenzaA__AHL81141

SEQ ID NO: 102673 - RNA, 1701 nt, Artificial Sequence; identical to SEQ ID NO: 98367
  derived and/or modified sequence opt2 from hemagglutinin__InfluenzaA__AHL81153

SEQ ID NO: 102674 - RNA, 1701 nt, Artificial Sequence
  derived and/or modified sequence opt2 from hemagglutinin__InfluenzaA__AHL81165
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccgccggcgagaucugcgacuccccccaccagauccucgacggcgagaacugcacccucaucgacgcccuccucggcgacccccagugcgacggcuuccagaacaagaagugggaccucuucgucgagcgcucccgcgccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102675 - RNA, 1701 nt, Artificial Sequence; identical to SEQ ID NO: 102674
  derived and/or modified sequence opt2 from hemagglutinin__InfluenzaA__AHL81177

SEQ ID NO: 102676 - RNA, 1701 nt, Artificial Sequence; identical to SEQ ID NO: 102661
  derived and/or modified sequence opt2 from hemagglutinin__InfluenzaA__AHL81189

SEQ ID NO: 102677 - RNA, 1701 nt, Artificial Sequence
  derived and/or modified sequence opt2 from hemagglutinin__InfluenzaA__AHL81212
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaagaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccgccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102678 - RNA, 1701 nt, Artificial Sequence
  derived and/or modified sequence opt2 from hemagglutinin__InfluenzaA__AHL81224
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaccgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102679 - RNA, 1701 nt, Artificial Sequence; identical to SEQ ID NO: 98367
  derived and/or modified sequence opt2 from hemagglutinin__InfluenzaA__AHL81235

SEQ ID NO: 102680 - RNA, 1701 nt, Artificial Sequence; identical to SEQ ID NO: 98367
  derived and/or modified sequence opt2 from hemagglutinin__InfluenzaA__AHL81247

SEQ ID NO: 102681 - RNA, 1701 nt, Artificial Sequence; identical to SEQ ID NO: 98367
  derived and/or modified sequence opt2 from hemagglutinin__InfluenzaA__AHL81259

SEQ ID NO: 102682 - RNA, 1701 nt, Artificial Sequence; identical to SEQ ID NO: 98367
  derived and/or modified sequence opt2 from hemagglutinin__InfluenzaA__AHL81271

SEQ ID NO: 102683 - RNA, 1701 nt, Artificial Sequence; identical to SEQ ID NO: 98367
  derived and/or modified sequence opt2 from hemagglutinin__InfluenzaA__AHL81283

SEQ ID NO: 102684 - RNA, 1701 nt, Artificial Sequence; identical to SEQ ID NO: 98367
  derived and/or modified sequence opt2 from hemagglutinin__InfluenzaA__AHL81295

SEQ ID NO: 102685 - RNA, 1701 nt, Artificial Sequence; identical to SEQ ID NO: 102660
  derived and/or modified sequence opt2 from hemagglutinin__InfluenzaA__AHL81307

SEQ ID NO: 102686 - RNA, 1701 nt, Artificial Sequence; identical to SEQ ID NO: 98379
  derived and/or modified sequence opt2 from hemagglutinin__InfluenzaA__AHL81329

SEQ ID NO: 102687 - RNA, 1701 nt, Artificial Sequence
  derived and/or modified sequence opt2 from hemagglutinin__InfluenzaA__AHL81340
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccaggacggcaccuccuccgccugcauccgcggcuccaagaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgccauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaagcgcuuccagaucaagggcaucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102688 - RNA, 1701 nt, Artificial Sequence; identical to SEQ ID NO: 98367
  derived and/or modified sequence opt2 from hemagglutinin__InfluenzaA__AHL81352

SEQ ID NO: 102689 - RNA, 1701 nt, Artificial Sequence
  derived and/or modified sequence opt2 from hemagglutinin__InfluenzaA__AHL81364
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcgccugcuaccccggcgacuucaucaacuacgaggagcuccgcgagcagcucuccuccgucuccuccuucgagcgcuucgagaucuuccccaagaccaacuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102690 - RNA, 1701 nt, Artificial Sequence
  derived and/or modified sequence opt2 from hemagglutinin__InfluenzaA__AHL81386
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccaacuccuggcccaaccacgacuccaacaagggcgucaccgccgccugcccccacgccggcgucaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102691 - RNA, 1701 nt, Artificial Sequence; identical to SEQ ID NO: 98367
  derived and/or modified sequence opt2 from hemagglutinin__InfluenzaA__AHL81397

SEQ ID NO: 102692 - RNA, 1701 nt, Artificial Sequence; identical to SEQ ID NO: 102677
  derived and/or modified sequence opt2 from hemagglutinin__InfluenzaA__AHL81409

SEQ ID NO: 102693 - RNA, 1701 nt, Artificial Sequence; identical to SEQ ID NO: 102647
  derived and/or modified sequence opt2 from hemagglutinin__InfluenzaA__AHL81419

SEQ ID NO: 102694 - RNA, 1701 nt, Artificial Sequence; identical to SEQ ID NO: 95345
  derived and/or modified sequence opt2 from hemagglutinin__InfluenzaA__AHL81430

SEQ ID NO: 102695 - RNA, 1701 nt, Artificial Sequence; identical to SEQ ID NO: 92142
  derived and/or modified sequence opt2 from hemagglutinin__InfluenzaA__AHL88951

SEQ ID NO: 102696 - RNA, 1701 nt, Artificial Sequence; identical to SEQ ID NO: 92142
  derived and/or modified sequence opt2 from hemagglutinin__InfluenzaA__AHL89030

SEQ ID NO: 102697 - RNA, 1701 nt, Artificial Sequence
  derived and/or modified sequence opt2 from hemagglutinin__InfluenzaA__AHL89042
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgagaacuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccucgucggcuucaucaugugggccugccagaagggcaacauccgcugcaacaucugcaucuga

SEQ ID NO: 102698 - RNA, 1701 nt, Artificial Sequence
  derived and/or modified sequence opt2 from hemagglutinin__InfluenzaA__AHL89054
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccauguccugcuuccuccucugcgucgcccuccucggcuucaucaugugggccugccagaagggcaacauccgcugcaacaucugcaucuga

SEQ ID NO: 102699 - RNA, 1701 nt, Artificial Sequence; identical to SEQ ID NO: 93093
  derived and/or modified sequence opt2 from hemagglutinin__InfluenzaA__AHL89066

SEQ ID NO: 102700 - RNA, 1701 nt, Artificial Sequence
  derived and/or modified sequence opt2 from hemagglutinin__InfluenzaA__AHL89078
augaagaccaucaucgcccucuccuacauccucugccucgucuucgcccagaagcuccccggcgacgacaacuccaccgccacccucugccucggccaccacgccguccccaacggcaccgucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102701 - RNA, 1701 nt, Artificial Sequence
  derived and/or modified sequence opt2 from hemagglutinin__InfluenzaA__AHL89090
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacucccccuaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102702 - RNA, 1701 nt, Artificial Sequence; identical to SEQ ID NO: 92142
  derived and/or modified sequence opt2 from hemagglutinin__InfluenzaA__AHL89102

SEQ ID NO: 102703 - RNA, 1701 nt, Artificial Sequence; identical to SEQ ID NO: 92142
  derived and/or modified sequence opt2 from hemagglutinin__InfluenzaA__AHL89114

SEQ ID NO: 102704 - RNA, 1701 nt, Artificial Sequence
  derived and/or modified sequence opt2 from hemagglutinin__InfluenzaA__AHL89126
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgagaacuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102705 - RNA, 1701 nt, Artificial Sequence
  derived and/or modified sequence opt2 from hemagglutinin__InfluenzaA__AHL89138
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaguccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102706 - RNA, 1701 nt, Artificial Sequence
  derived and/or modified sequence opt2 from hemagglutinin__InfluenzaA__AHL89150
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucgucuucaucaugugggccugccagaagggcaacauccgcugcaacaucugcaucuga

SEQ ID NO: 102707 - RNA, 1701 nt, Artificial Sequence
  derived and/or modified sequence opt2 from hemagglutinin__InfluenzaA__AHL89162
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaccaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102708 - RNA, 1701 nt, Artificial Sequence
  derived and/or modified sequence opt2 from hemagglutinin__InfluenzaA__AHL89174
augaagaccaucaucgcccucuccuacacccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102709 - RNA, 1701 nt, Artificial Sequence
  derived and/or modified sequence opt2 from hemagglutinin__InfluenzaA__AHL89210
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102710 - RNA, 1701 nt, Artificial Sequence; identical to SEQ ID NO: 102709
  derived and/or modified sequence opt2 from hemagglutinin__InfluenzaA__AHL89222

SEQ ID NO: 102711 - RNA, 1701 nt, Artificial Sequence
  derived and/or modified sequence opt2 from hemagglutinin__InfluenzaA__AHL89234
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaugggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102712 - RNA, 1701 nt, Artificial Sequence
  derived and/or modified sequence opt2 from hemagglutinin__InfluenzaA__AHL89246
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcggcaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102713 - RNA, 1701 nt, Artificial Sequence
  derived and/or modified sequence opt2 from hemagglutinin__InfluenzaA__AHL89258
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccaggcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 102714 - RNA, 1701 nt, Artificial Sequence; identical to SEQ ID NO: 102709
  derived and/or modified sequence opt2 from hemagglutinin__InfluenzaA__AHL89270

SEQ ID NO: 102715 - RNA, 1701 nt, Artificial Sequence; identical to SEQ ID NO: 102709
  derived and/or modified sequence opt2 from hemagglutinin__InfluenzaA__AHL89282

SEQ ID NO: 102716 - RNA, 1701 nt, Artificial Sequence; identical to SEQ ID NO: 102709
  derived and/or modified sequence opt2 from hemagglutinin__InfluenzaA__AHL89294

SEQ ID NO: 102717 - RNA, 1701 nt, Artificial Sequence; identical to SEQ ID NO: 102709
  derived and/or modified sequence opt2 from hemagglutinin__InfluenzaA__AHL89306

SEQ ID NO: 102718 - RNA, 1701 nt, Artificial Sequence; identical to SEQ ID NO: 93093
  derived and/or modified sequence opt2 from hemagglutinin__InfluenzaA__AHL89318

SEQ ID NO: 102719 - RNA, 1701 nt, Artificial Sequence
  derived and/or modified sequence opt2 from hemagglutinin__InfluenzaA__AHL89330
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcaagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102720 - RNA, 1701 nt, Artificial Sequence; identical to SEQ ID NO: 92142
  derived and/or modified sequence opt2 from hemagglutinin__InfluenzaA__AHL89342

SEQ ID NO: 102721 - RNA, 1701 nt, Artificial Sequence; identical to SEQ ID NO: 93073
  derived and/or modified sequence opt2 from hemagglutinin__InfluenzaA__AHL89354

SEQ ID NO: 102722 - RNA, 1701 nt, Artificial Sequence
  derived and/or modified sequence opt2 from hemagglutinin__InfluenzaA__AHL89366
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugaaguccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcaucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 102723 - RNA, 1701 nt, Artificial Sequence; identical to SEQ ID NO: 102709
  derived and/or modified sequence opt2 from hemagglutinin__InfluenzaA__AHL89378

SEQ ID NO: 102724 - RNA, 1701 nt, Artificial Sequence; identical to SEQ ID NO: 93340
  derived and/or modified sequence opt2 from hemagglutinin__InfluenzaA__AHL89390

SEQ ID NO: 102725 - RNA, 1701 nt, Artificial Sequence; identical to SEQ ID NO: 102709
  derived and/or modified sequence opt2 from hemagglutinin__InfluenzaA__AHL89402

SEQ ID NO: 102726 - RNA, 1701 nt, Artificial Sequence; identical to SEQ ID NO: 93093
  derived and/or modified sequence opt2 from hemagglutinin__InfluenzaA__AHL89414

SEQ ID NO: 102727 - RNA, 1701 nt, Artificial Sequence
  derived and/or modified sequence opt2 from hemagglutinin__InfluenzaA__AHL89426
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccucuucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 102728 - RNA, 1701 nt, Artificial Sequence; identical to SEQ ID NO: 102709
  derived and/or modified sequence opt2 from hemagglutinin__InfluenzaA__AHL89438

SEQ ID NO: 102729 - RNA, 1701 nt, Artificial Sequence; identical to SEQ ID NO: 102709
  derived and/or modified sequence opt2 from hemagglutinin__InfluenzaA__AHL89450

SEQ ID NO: 102730 - RNA, 1701 nt, Artificial Sequence; identical to SEQ ID NO: 102709
  derived and/or modified sequence opt2 from hemagglutinin__InfluenzaA__AHL89462

SEQ ID NO: 102731 - RNA, 1701 nt, Artificial Sequence; identical to SEQ ID NO: 102709
  derived and/or modified sequence opt2 from hemagglutinin__InfluenzaA__AHL89474

SEQ ID NO: 102732 - RNA, 1701 nt, Artificial Sequence; identical to SEQ ID NO: 93340
  derived and/or modified sequence opt2 from hemagglutinin__InfluenzaA__AHL89486

SEQ ID NO: 102733 - RNA, 1701 nt, Artificial Sequence; identical to SEQ ID NO: 93093
  derived and/or modified sequence opt2 from hemagglutinin__InfluenzaA__AHL89498

SEQ ID NO: 102734 - RNA, 1701 nt, Artificial Sequence; identical to SEQ ID NO: 93093
  derived and/or modified sequence opt2 from hemagglutinin__InfluenzaA__AHL89510

SEQ ID NO: 102735 - RNA, 1701 nt, Artificial Sequence; identical to SEQ ID NO: 93093
  derived and/or modified sequence opt2 from hemagglutinin__InfluenzaA__AHL89522

SEQ ID NO: 102736 - RNA, 1701 nt, Artificial Sequence
  derived and/or modified sequence opt2 from hemagglutinin__InfluenzaA__AHL89534
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcaucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 102737 - RNA, 1698 nt, Artificial Sequence
  derived and/or modified sequence opt2 from hemagglutinin__InfluenzaA__AHL89546
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgaguccgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagcgcaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 102738 - RNA, 1698 nt, Artificial Sequence; identical to SEQ ID NO: 93426
  derived and/or modified sequence opt2 from hemagglutinin__InfluenzaA__AHL89558

SEQ ID NO: 102739 - RNA, 1698 nt, Artificial Sequence; identical to SEQ ID NO: 93426
  derived and/or modified sequence opt2 from hemagglutinin__InfluenzaA__AHL89570

SEQ ID NO: 102740 - RNA, 1698 nt, Artificial Sequence; identical to SEQ ID NO: 93442
  derived and/or modified sequence opt2 from hemagglutinin__InfluenzaA__AHL89582

SEQ ID NO: 102741 - RNA, 1698 nt, Artificial Sequence; identical to SEQ ID NO: 93442
  derived and/or modified sequence opt2 from hemagglutinin__InfluenzaA__AHL89594

SEQ ID NO: 102742 - RNA, 1698 nt, Artificial Sequence; identical to SEQ ID NO: 93442
  derived and/or modified sequence opt2 from hemagglutinin__InfluenzaA__AHL89606

SEQ ID NO: 102743 - RNA, 1698 nt, Artificial Sequence; identical to SEQ ID NO: 93426
  derived and/or modified sequence opt2 from hemagglutinin__InfluenzaA__AHL89618

SEQ ID NO: 102744 - RNA, 1698 nt, Artificial Sequence; identical to SEQ ID NO: 93442
  derived and/or modified sequence opt2 from hemagglutinin__InfluenzaA__AHL89630

SEQ ID NO: 102745 - RNA, 1698 nt, Artificial Sequence
  derived and/or modified sequence opt2 from hemagglutinin__InfluenzaA__AHL89642
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacaaccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 102746 - RNA, 1698 nt, Artificial Sequence; identical to SEQ ID NO: 93457
  derived and/or modified sequence opt2 from hemagglutinin__InfluenzaA__AHL89654

SEQ ID NO: 102747 - RNA, 1698 nt, Artificial Sequence
  derived and/or modified sequence opt2 from hemagglutinin__InfluenzaA__AHL89666
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacaaccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccgaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 102748 - RNA, 1698 nt, Artificial Sequence
  derived and/or modified sequence opt2 from hemagglutinin__InfluenzaA__AHL89678
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccaugggcgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcaagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 102749 - RNA, 1698 nt, Artificial Sequence
  derived and/or modified sequence opt2 from hemagglutinin__InfluenzaA__AHL89690
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccgaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuacaagaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 102750 - RNA, 1698 nt, Artificial Sequence; identical to SEQ ID NO: 93457
  derived and/or modified sequence opt2 from hemagglutinin__InfluenzaA__AHL89702

SEQ ID NO: 102751 - RNA, 1698 nt, Artificial Sequence; identical to SEQ ID NO: 93426
  derived and/or modified sequence opt2 from hemagglutinin__InfluenzaA__AHL89714

SEQ ID NO: 102752 - RNA, 1698 nt, Artificial Sequence
  derived and/or modified sequence opt2 from hemagglutinin__InfluenzaA__AHL89726
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 102753 - RNA, 1698 nt, Artificial Sequence
  derived and/or modified sequence opt2 from hemagglutinin__InfluenzaA__AHL89750
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacggcugcgacgccaagugccagaccccccagggcgccaucaacuccucccuccccuuccagaacguccaccccgucaccaucggcgagugccccaaguacguccgcuccaccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 102754 - RNA, 1698 nt, Artificial Sequence; identical to SEQ ID NO: 93422
  derived and/or modified sequence opt2 from hemagglutinin__InfluenzaA__AHL89762

SEQ ID NO: 102755 - RNA, 1698 nt, Artificial Sequence; identical to SEQ ID NO: 93468
  derived and/or modified sequence opt2 from hemagglutinin__InfluenzaA__AHL89774

SEQ ID NO: 102756 - RNA, 1698 nt, Artificial Sequence; identical to SEQ ID NO: 93457
  derived and/or modified sequence opt2 from hemagglutinin__InfluenzaA__AHL89786

SEQ ID NO: 102757 - RNA, 1698 nt, Artificial Sequence
  derived and/or modified sequence opt2 from hemagglutinin__InfluenzaA__AHL89798
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggaccgccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucucccgcuccuacgccaacaacaaggagaaggagguccucguccucuggggcguccaccacccccccuccaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 102758 - RNA, 1698 nt, Artificial Sequence
  derived and/or modified sequence opt2 from hemagglutinin__InfluenzaA__AHL89810
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccaugggcgagugcgacgccgagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 102759 - RNA, 1698 nt, Artificial Sequence
  derived and/or modified sequence opt2 from hemagglutinin__InfluenzaA__AHL89822
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggaccgccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 102760 - RNA, 1698 nt, Artificial Sequence
  derived and/or modified sequence opt2 from hemagglutinin__InfluenzaA__AHL89834
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagcuccucaucuccaaggaguccugguccuacaucgucgagacccccaaccccgagaacggcaccugcuaccccggcaacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcaaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagcgcgcccucuaccacaccgagaacgccuacgucuccgucgucuccucccacuacucccgccgcuucacccccgagaucgccaagcgccccaagguccgcgaccaggagggccgcaucaacuacuacuggacccuccucgagcccggcgacaccaucaucuucgaggccaacggcaaccucaucgccccccgcuucgccuucgcccucucccgcggcuucggcuccggcaucaucaccuccaacgcccccauggacgagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcgacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 102761 - RNA, 1698 nt, Artificial Sequence; identical to SEQ ID NO: 93468
  derived and/or modified sequence opt2 from hemagglutinin__InfluenzaA__AHL89846

SEQ ID NO: 102762 - RNA, 1701 nt, Artificial Sequence; identical to SEQ ID NO: 93440
  derived and/or modified sequence opt2 from hemagglutinin__InfluenzaA__AHL89858

SEQ ID NO: 102763 - RNA, 1701 nt, Artificial Sequence; identical to SEQ ID NO: 93440
  derived and/or modified sequence opt2 from hemagglutinin__InfluenzaA__AHL89870

SEQ ID NO: 102764 - RNA, 1701 nt, Artificial Sequence
  derived and/or modified sequence opt2 from hemagglutinin__InfluenzaA__AHL89882
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgcggcuccgacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102765 - RNA, 1701 nt, Artificial Sequence; identical to SEQ ID NO: 93440
  derived and/or modified sequence opt2 from hemagglutinin__InfluenzaA__AHL89894

SEQ ID NO: 102766 - RNA, 1701 nt, Artificial Sequence
  derived and/or modified sequence opt2 from hemagglutinin__InfluenzaA__AHL89906
augaagaccaucaucgcccucuccuacauccucugccucgucuacgcccagaagcuccccggcaucgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcaagcgcggcuccaacaacuccuucuucucccgccucaacuggcucacccacuccaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacguccgccagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102767 - RNA, 1701 nt, Artificial Sequence
  derived and/or modified sequence opt2 from hemagglutinin__InfluenzaA__AHL89918
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaccuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102768 - RNA, 1701 nt, Artificial Sequence
  derived and/or modified sequence opt2 from hemagglutinin__InfluenzaA__AHL89930
augaagaccaucaucgcccucuccuacauccucugccucgucuucgcccagaagcuccccggcaucgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcaagcgcggcuccaacaacuccuucuucucccgccucaacuggcucacccacuccaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucuccaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaugggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102769 - RNA, 1701 nt, Artificial Sequence; identical to SEQ ID NO: 93427
  derived and/or modified sequence opt2 from hemagglutinin__InfluenzaA__AHL89942

SEQ ID NO: 102770 - RNA, 1701 nt, Artificial Sequence
  derived and/or modified sequence opt2 from hemagglutinin__InfluenzaA__AHL89954
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgaccacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102771 - RNA, 1701 nt, Artificial Sequence; identical to SEQ ID NO: 93440
  derived and/or modified sequence opt2 from hemagglutinin__InfluenzaA__AHL89966

SEQ ID NO: 102772 - RNA, 1701 nt, Artificial Sequence; identical to SEQ ID NO: 93440
  derived and/or modified sequence opt2 from hemagglutinin__InfluenzaA__AHL89978

SEQ ID NO: 102773 - RNA, 1701 nt, Artificial Sequence; identical to SEQ ID NO: 93499
  derived and/or modified sequence opt2 from hemagglutinin__InfluenzaA__AHL89990

SEQ ID NO: 102774 - RNA, 1701 nt, Artificial Sequence
  derived and/or modified sequence opt2 from hemagglutinin__InfluenzaA__AHL90002
augaagaccaucaucgcccucuccuacauccucugccucgucuucgcccagaagcuccccggcaucgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcaagcgcggcuccaacaacuccuucuucucccgccucaacuggcucacccacuccaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaugggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102775 - RNA, 1701 nt, Artificial Sequence
  derived and/or modified sequence opt2 from hemagglutinin__InfluenzaA__AHL90014
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccaggucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102776 - RNA, 1701 nt, Artificial Sequence; identical to SEQ ID NO: 102775
  derived and/or modified sequence opt2 from hemagglutinin__InfluenzaA__AHL90026

SEQ ID NO: 102777 - RNA, 1701 nt, Artificial Sequence
  derived and/or modified sequence opt2 from hemagglutinin__InfluenzaA__AHL90050
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacgccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102778 - RNA, 1701 nt, Artificial Sequence
  derived and/or modified sequence opt2 from hemagglutinin__InfluenzaA__AHL90062
augaagaccaucaucgcccucuccuacauccucugccucgucuucgcccagaagcuccccgagaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacuacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102779 - RNA, 1701 nt, Artificial Sequence; identical to SEQ ID NO: 93440
  derived and/or modified sequence opt2 from hemagglutinin__InfluenzaA__AHL90074

SEQ ID NO: 102780 - RNA, 1701 nt, Artificial Sequence
  derived and/or modified sequence opt2 from hemagglutinin__InfluenzaA__AHL90086
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuacaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102781 - RNA, 1701 nt, Artificial Sequence
  derived and/or modified sequence opt2 from hemagglutinin__InfluenzaA__AHL90098
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcggcaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaagcgcggcuccgacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucgacaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucaaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102782 - RNA, 1701 nt, Artificial Sequence
  derived and/or modified sequence opt2 from hemagglutinin__InfluenzaA__AHL90110
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccaguccggcaaguccuccgucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102783 - RNA, 1698 nt, Artificial Sequence; identical to SEQ ID NO: 95607
  derived and/or modified sequence opt2 from hemagglutinin__InfluenzaA__AHL90122

SEQ ID NO: 102784 - RNA, 1698 nt, Artificial Sequence; identical to SEQ ID NO: 94000
  derived and/or modified sequence opt2 from hemagglutinin__InfluenzaA__AHL90133

SEQ ID NO: 102785 - RNA, 1698 nt, Artificial Sequence; identical to SEQ ID NO: 95607
  derived and/or modified sequence opt2 from hemagglutinin__InfluenzaA__AHL90145

SEQ ID NO: 102786 - RNA, 1698 nt, Artificial Sequence
  derived and/or modified sequence opt2 from hemagglutinin__InfluenzaA__AHL90157
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagauccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccaucgccuccucccucguccuccucgucucccucggcgccaucuccuucuggaugugcuccaacggcucccuccagugccgcaucugcaucuga

SEQ ID NO: 102787 - RNA, 1698 nt, Artificial Sequence; identical to SEQ ID NO: 95607
  derived and/or modified sequence opt2 from hemagglutinin__InfluenzaA__AHL90169

SEQ ID NO: 102788 - RNA, 1698 nt, Artificial Sequence
  derived and/or modified sequence opt2 from hemagglutinin__InfluenzaA__AHL90181
augaaggucaagcuccucguccuccucugcaccuucgccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccaagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 102789 - RNA, 1698 nt, Artificial Sequence; identical to SEQ ID NO: 94682
  derived and/or modified sequence opt2 from hemagglutinin__InfluenzaA__AHL90217

SEQ ID NO: 102790 - RNA, 1698 nt, Artificial Sequence; identical to SEQ ID NO: 94682
  derived and/or modified sequence opt2 from hemagglutinin__InfluenzaA__AHL90229

SEQ ID NO: 102791 - RNA, 1698 nt, Artificial Sequence
  derived and/or modified sequence opt2 from hemagglutinin__InfluenzaA__AHL90241
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucauccccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 102792 - RNA, 1698 nt, Artificial Sequence
  derived and/or modified sequence opt2 from hemagglutinin__InfluenzaA__AHL90253
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaagggcuccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggucuccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 102793 - RNA, 1698 nt, Artificial Sequence; identical to SEQ ID NO: 94000
  derived and/or modified sequence opt2 from hemagglutinin__InfluenzaA__AHL90265

SEQ ID NO: 102794 - RNA, 1698 nt, Artificial Sequence
  derived and/or modified sequence opt2 from hemagglutinin__InfluenzaA__AHL90277
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucgucgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 102795 - RNA, 1698 nt, Artificial Sequence
  derived and/or modified sequence opt2 from hemagglutinin__InfluenzaA__AHL90289
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagccccgcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 102796 - RNA, 1698 nt, Artificial Sequence; identical to SEQ ID NO: 102795
  derived and/or modified sequence opt2 from hemagglutinin__InfluenzaA__AHL90301

SEQ ID NO: 102797 - RNA, 1698 nt, Artificial Sequence
  derived and/or modified sequence opt2 from hemagglutinin__InfluenzaA__AHL90325
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaaggcccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaugggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 102798 - RNA, 1698 nt, Artificial Sequence; identical to SEQ ID NO: 102797
  derived and/or modified sequence opt2 from hemagglutinin__InfluenzaA__AHL90337

SEQ ID NO: 102799 - RNA, 1698 nt, Artificial Sequence; identical to SEQ ID NO: 94000
  derived and/or modified sequence opt2 from hemagglutinin__InfluenzaA__AHL90349

SEQ ID NO: 102800 - RNA, 1698 nt, Artificial Sequence; identical to SEQ ID NO: 94000
  derived and/or modified sequence opt2 from hemagglutinin__InfluenzaA__AHL90361

SEQ ID NO: 102801 - RNA, 1698 nt, Artificial Sequence; identical to SEQ ID NO: 102794
  derived and/or modified sequence opt2 from hemagglutinin__InfluenzaA__AHL90373

SEQ ID NO: 102802 - RNA, 1701 nt, Artificial Sequence
  derived and/or modified sequence opt2 from hemagglutinin__InfluenzaA__AHL90385
augaagaccaucaucgcccucuccuacauccagugccucgucuucgcccagaaguuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaacugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccacuccaaguucaaguaccccgcccucaacgucaccaugcccaacaacgagaacuucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggccgcaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcaucgcccuccucggcuucaucaugugggccugccagaagggcaacauccgcugcaacaucugcaucuga

SEQ ID NO: 102803 - RNA, 1701 nt, Artificial Sequence
  derived and/or modified sequence opt2 from hemagglutinin__InfluenzaA__AHL90397
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcuccuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102804 - RNA, 1701 nt, Artificial Sequence; identical to SEQ ID NO: 93946
  derived and/or modified sequence opt2 from hemagglutinin__InfluenzaA__AHL90410

SEQ ID NO: 102805 - RNA, 1701 nt, Artificial Sequence
  derived and/or modified sequence opt2 from hemagglutinin__InfluenzaA__AHL90422
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccacuccaaguucaaguaccccgcccucaacgucaccaugcccaacaacgaggaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagauguccaagcucuucgagaagaccaagaagcagcuccgcgagaacgccgaggacaugggcaacggcugcuucaagaucuaccacaagugcgacaacaccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102806 - RNA, 1701 nt, Artificial Sequence; identical to SEQ ID NO: 93946
  derived and/or modified sequence opt2 from hemagglutinin__InfluenzaA__AHL90434

SEQ ID NO: 102807 - RNA, 1701 nt, Artificial Sequence; identical to SEQ ID NO: 93946
  derived and/or modified sequence opt2 from hemagglutinin__InfluenzaA__AHL90446

SEQ ID NO: 102808 - RNA, 1701 nt, Artificial Sequence
  derived and/or modified sequence opt2 from hemagglutinin__InfluenzaA__AHL90458
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcgcccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102809 - RNA, 1701 nt, Artificial Sequence; identical to SEQ ID NO: 93946
  derived and/or modified sequence opt2 from hemagglutinin__InfluenzaA__AHL90470

SEQ ID NO: 102810 - RNA, 1701 nt, Artificial Sequence; identical to SEQ ID NO: 93946
  derived and/or modified sequence opt2 from hemagglutinin__InfluenzaA__AHL90482

SEQ ID NO: 102811 - RNA, 1701 nt, Artificial Sequence; identical to SEQ ID NO: 94049
  derived and/or modified sequence opt2 from hemagglutinin__InfluenzaA__AHL90494

SEQ ID NO: 102812 - RNA, 1701 nt, Artificial Sequence; identical to SEQ ID NO: 94049
  derived and/or modified sequence opt2 from hemagglutinin__InfluenzaA__AHL90506

SEQ ID NO: 102813 - RNA, 1701 nt, Artificial Sequence
  derived and/or modified sequence opt2 from hemagglutinin__InfluenzaA__AHL90518
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaagaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaaggagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102814 - RNA, 1701 nt, Artificial Sequence; identical to SEQ ID NO: 94725
  derived and/or modified sequence opt2 from hemagglutinin__InfluenzaA__AHL90530

SEQ ID NO: 102815 - RNA, 1701 nt, Artificial Sequence; identical to SEQ ID NO: 93946
  derived and/or modified sequence opt2 from hemagglutinin__InfluenzaA__AHL90542

SEQ ID NO: 102816 - RNA, 1701 nt, Artificial Sequence; identical to SEQ ID NO: 93946
  derived and/or modified sequence opt2 from hemagglutinin__InfluenzaA__AHL90554

SEQ ID NO: 102817 - RNA, 1701 nt, Artificial Sequence; identical to SEQ ID NO: 93946
  derived and/or modified sequence opt2 from hemagglutinin__InfluenzaA__AHL90566

SEQ ID NO: 102818 - RNA, 1701 nt, Artificial Sequence; identical to SEQ ID NO: 93946
  derived and/or modified sequence opt2 from hemagglutinin__InfluenzaA__AHL90578

SEQ ID NO: 102819 - RNA, 1701 nt, Artificial Sequence; identical to SEQ ID NO: 94049
  derived and/or modified sequence opt2 from hemagglutinin__InfluenzaA__AHL90590

SEQ ID NO: 102820 - RNA, 1701 nt, Artificial Sequence; identical to SEQ ID NO: 93946
  derived and/or modified sequence opt2 from hemagglutinin__InfluenzaA__AHL90602

SEQ ID NO: 102821 - RNA, 1701 nt, Artificial Sequence; identical to SEQ ID NO: 93946
  derived and/or modified sequence opt2 from hemagglutinin__InfluenzaA__AHL90614

SEQ ID NO: 102822 - RNA, 1701 nt, Artificial Sequence
  derived and/or modified sequence opt2 from hemagglutinin__InfluenzaA__AHL90638
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcucccgcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102823 - RNA, 1701 nt, Artificial Sequence
  derived and/or modified sequence opt2 from hemagglutinin__InfluenzaA__AHL90650
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaccuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102824 - RNA, 1701 nt, Artificial Sequence; identical to SEQ ID NO: 93946
  derived and/or modified sequence opt2 from hemagglutinin__InfluenzaA__AHL90662

SEQ ID NO: 102825 - RNA, 1701 nt, Artificial Sequence
  derived and/or modified sequence opt2 from hemagglutinin__InfluenzaA__AHL90674
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgucugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102826 - RNA, 1701 nt, Artificial Sequence
  derived and/or modified sequence opt2 from hemagglutinin__InfluenzaA__AHL90686
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgccauggagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102827 - RNA, 1701 nt, Artificial Sequence; identical to SEQ ID NO: 93946
  derived and/or modified sequence opt2 from hemagglutinin__InfluenzaA__AHL90698

SEQ ID NO: 102828 - RNA, 1701 nt, Artificial Sequence; identical to SEQ ID NO: 93946
  derived and/or modified sequence opt2 from hemagglutinin__InfluenzaA__AHL90710

SEQ ID NO: 102829 - RNA, 1698 nt, Artificial Sequence; identical to SEQ ID NO: 97484
  derived and/or modified sequence opt2 from hemagglutinin__InfluenzaA__AHL90722

SEQ ID NO: 102830 - RNA, 1698 nt, Artificial Sequence
  derived and/or modified sequence opt2 from hemagglutinin__InfluenzaA__AHL90746
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucaagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccaugggcaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 102831 - RNA, 1698 nt, Artificial Sequence; identical to SEQ ID NO: 94643
  derived and/or modified sequence opt2 from hemagglutinin__InfluenzaA__AHL90758

SEQ ID NO: 102832 - RNA, 1698 nt, Artificial Sequence
  derived and/or modified sequence opt2 from hemagglutinin__InfluenzaA__AHL90770
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggacuccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccuccaucaacgaccagaagacccucuaccacaccgagaacgccuacgucuccgucgucuccucccaccacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucaccaucuacuccaccgucgccuccucccucguccuccucgucucccucggcgccaucuccuucuggaugugcuccaacggcucccuccagugccgcaucugcaucuga

SEQ ID NO: 102833 - RNA, 1698 nt, Artificial Sequence; identical to SEQ ID NO: 95128
  derived and/or modified sequence opt2 from hemagglutinin__InfluenzaA__AHL90782

SEQ ID NO: 102834 - RNA, 1698 nt, Artificial Sequence
  derived and/or modified sequence opt2 from hemagglutinin__InfluenzaA__AHL90794
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucggcgaccagaacacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 102835 - RNA, 1698 nt, Artificial Sequence
  derived and/or modified sequence opt2 from hemagglutinin__InfluenzaA__AHL90806
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucaucucccucggcgccaucuccuucuggaugugcuccaacggcucccuccagugccgcaucugcaucuga

SEQ ID NO: 102836 - RNA, 1698 nt, Artificial Sequence; identical to SEQ ID NO: 97484
  derived and/or modified sequence opt2 from hemagglutinin__InfluenzaA__AHL90818

SEQ ID NO: 102837 - RNA, 1698 nt, Artificial Sequence; identical to SEQ ID NO: 97484
  derived and/or modified sequence opt2 from hemagglutinin__InfluenzaA__AHL90830

SEQ ID NO: 102838 - RNA, 1698 nt, Artificial Sequence; identical to SEQ ID NO: 94643
  derived and/or modified sequence opt2 from hemagglutinin__InfluenzaA__AHL90842

SEQ ID NO: 102839 - RNA, 1698 nt, Artificial Sequence; identical to SEQ ID NO: 97025
  derived and/or modified sequence opt2 from hemagglutinin__InfluenzaA__AHL90854

SEQ ID NO: 102840 - RNA, 1698 nt, Artificial Sequence; identical to SEQ ID NO: 94643
  derived and/or modified sequence opt2 from hemagglutinin__InfluenzaA__AHL90866

SEQ ID NO: 102841 - RNA, 1698 nt, Artificial Sequence; identical to SEQ ID NO: 97025
  derived and/or modified sequence opt2 from hemagglutinin__InfluenzaA__AHL90878

SEQ ID NO: 102842 - RNA, 1698 nt, Artificial Sequence; identical to SEQ ID NO: 97484
  derived and/or modified sequence opt2 from hemagglutinin__InfluenzaA__AHL90890

SEQ ID NO: 102843 - RNA, 1698 nt, Artificial Sequence; identical to SEQ ID NO: 97025
  derived and/or modified sequence opt2 from hemagglutinin__InfluenzaA__AHL90902

SEQ ID NO: 102844 - RNA, 1698 nt, Artificial Sequence; identical to SEQ ID NO: 94643
  derived and/or modified sequence opt2 from hemagglutinin__InfluenzaA__AHL90914

SEQ ID NO: 102845 - RNA, 1698 nt, Artificial Sequence; identical to SEQ ID NO: 97025
  derived and/or modified sequence opt2 from hemagglutinin__InfluenzaA__AHL90938

SEQ ID NO: 102846 - RNA, 1698 nt, Artificial Sequence; identical to SEQ ID NO: 97025
  derived and/or modified sequence opt2 from hemagglutinin__InfluenzaA__AHL90950

SEQ ID NO: 102847 - RNA, 1698 nt, Artificial Sequence; identical to SEQ ID NO: 97025
  derived and/or modified sequence opt2 from hemagglutinin__InfluenzaA__AHL90962

SEQ ID NO: 102848 - RNA, 1698 nt, Artificial Sequence
  derived and/or modified sequence opt2 from hemagglutinin__InfluenzaA__AHL90974
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccuccaucuccgaccagaagacccucuaccacaccgagaacgccuacgucuccgucgucuccucccacuacucccgcaaguucacccccgaggucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagggccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 102849 - RNA, 1698 nt, Artificial Sequence
  derived and/or modified sequence opt2 from hemagglutinin__InfluenzaA__AHL90986
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggaguccuccuggcccaaccacaccgucaccggcgucuccgccuccugcucccacaacggcgaguccuccuucuaccgcaaccuccucuggcucaccgucaagaacggccucuaccccaaccucuccaaguccuacgccaacaacaaggagaaggagguccucguccucuggggcguccaccacccccccaacaucgucgaccagaagacccucuaccgcaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucuccaagggcuucggcuccggcaucaucaacuccaacgcccccauggacaagugcgacgccaagugccagaccccccgcggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 102850 - RNA, 1698 nt, Artificial Sequence
  derived and/or modified sequence opt2 from hemagglutinin__InfluenzaA__AHL91010
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggacuccuccuggcccaaccacaccgucaccggcgucuccgccuccugcucccacaacggcgaguccuccuucuaccgcaaccuccucuggcucaccggcaagaacggccucuaccccaaccucuccaaguccuacgccaacaacaaggagaaggagguccucguccucuggggcguccaccacccccccuccaucaacgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucaccaucuacuccaccgucgccuccucccucguccuccucgucucccucggcgccaucuccuucuggaugugcuccaacggcucccuccagugccgcaucugcaucuga

SEQ ID NO: 102851 - RNA, 1698 nt, Artificial Sequence
  derived and/or modified sequence opt2 from hemagglutinin__InfluenzaA__AHL91022
augaaggucaagcuccucguccuccucugcaccuucaccgccaccuacgccgacaccaucugcaucggcuaccacgccaacaacuccaccgacaccgucgacaccguccucgagaagaacgucaccgucacccacuccgucaaccuccucgagaacucccacaacggcaagcucugccuccucaagggcaucgccccccuccagcucggcaacugcuccgucgccggcuggauccucggcaaccccgagugcgagcuccucaucuccaaggaguccugguccuacaucgucgagaagcccaaccccgagaacggcaccugcuaccccggccacuucgccgacuacgaggagcuccgcgagcagcucuccuccgucuccuccuucgagcgcuucgagaucuuccccaaggacuccuccuggcccaaccacaccgucaccggcgucuccgccuccugcucccacaacggcgagaacuccuucuaccgcaaccuccucuggcucaccggcaagaacggccucuaccccaaccucuccaaguccuacgccaacaacaaggagaaggagguccucguccucuggggcguccaccacccccccuccaucaacgaccagaagacccucuaccacaccgagaacgccuacgucuccgucgucuccucccacuacucccgcaaguucacccccgagaucgccaagcgccccaagguccgcgaccaggagggccgcaucaacuacuacuggacccuccucgagcccggcgacaccaucaucuucgaggccaacggcaaccucaucgccccccgcuacgccuucgcccucucccgcggcuucggcuccggcaucaucaacuccaacgcccccauggacaagugcgacgccaagugccagaccccccagggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucaacggcaucaccaacaaggucaacuccgucaucgagaagaugaacacccaguucaccgccgucggcaaggaguucaacaagcucgagcgccgcauggagaaccucaacaagaaggucgacgacggcuucaucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacgacgagugcauggaguccgucaagaacggcaccuacgacuaccccaaguacuccgaggaguccaagcucaaccgcgagaagaucgacggcgucaagcucgaguccaugggcgucuaccagauccucaccaucuacuccaccgucgccuccucccucguccuccucgucucccucggcgccaucuccuucuggaugugcuccaacggcucccuccagugccgcaucugcaucuga

SEQ ID NO: 102852 - RNA, 1701 nt, Artificial Sequence; identical to SEQ ID NO: 93946
  derived and/or modified sequence opt2 from hemagglutinin__InfluenzaA__AHL91034

SEQ ID NO: 102853 - RNA, 1701 nt, Artificial Sequence; identical to SEQ ID NO: 97012
  derived and/or modified sequence opt2 from hemagglutinin__InfluenzaA__AHL91046

SEQ ID NO: 102854 - RNA, 1701 nt, Artificial Sequence; identical to SEQ ID NO: 102826
  derived and/or modified sequence opt2 from hemagglutinin__InfluenzaA__AHL91058

SEQ ID NO: 102855 - RNA, 1701 nt, Artificial Sequence
  derived and/or modified sequence opt2 from hemagglutinin__InfluenzaA__AHL91070
augaagaccaucaucgcccucuccuacauccucugccucgucuucgcccagaagcuccccggcaacgacaacuccauggccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcaugcgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102856 - RNA, 1701 nt, Artificial Sequence
  derived and/or modified sequence opt2 from hemagglutinin__InfluenzaA__AHL91082
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugccccaucuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102857 - RNA, 1701 nt, Artificial Sequence; identical to SEQ ID NO: 96931
  derived and/or modified sequence opt2 from hemagglutinin__InfluenzaA__AHL91094

SEQ ID NO: 102858 - RNA, 1701 nt, Artificial Sequence
  derived and/or modified sequence opt2 from hemagglutinin__InfluenzaA__AHL91106
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaagggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102859 - RNA, 1701 nt, Artificial Sequence
  derived and/or modified sequence opt2 from hemagglutinin__InfluenzaA__AHL91118
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucuccaagcucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucacccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102860 - RNA, 1701 nt, Artificial Sequence
  derived and/or modified sequence opt2 from hemagglutinin__InfluenzaA__AHL91130
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucaucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacaacgagcaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102861 - RNA, 1701 nt, Artificial Sequence; identical to SEQ ID NO: 93946
  derived and/or modified sequence opt2 from hemagglutinin__InfluenzaA__AHL91142

SEQ ID NO: 102862 - RNA, 1701 nt, Artificial Sequence; identical to SEQ ID NO: 93946
  derived and/or modified sequence opt2 from hemagglutinin__InfluenzaA__AHL91154

SEQ ID NO: 102863 - RNA, 1701 nt, Artificial Sequence; identical to SEQ ID NO: 92142
  derived and/or modified sequence opt2 from hemagglutinin__InfluenzaA__AHL91166

SEQ ID NO: 102864 - RNA, 1701 nt, Artificial Sequence; identical to SEQ ID NO: 101979
  derived and/or modified sequence opt2 from hemagglutinin__InfluenzaA__AHL94984

SEQ ID NO: 102865 - RNA, 1701 nt, Artificial Sequence; identical to SEQ ID NO: 101979
  derived and/or modified sequence opt2 from hemagglutinin__InfluenzaA__AHL94996

SEQ ID NO: 102866 - RNA, 1701 nt, Artificial Sequence; identical to SEQ ID NO: 101347
  derived and/or modified sequence opt2 from hemagglutinin__InfluenzaA__AHL95008

SEQ ID NO: 102867 - RNA, 1701 nt, Artificial Sequence; identical to SEQ ID NO: 101509
  derived and/or modified sequence opt2 from hemagglutinin__InfluenzaA__AHL95020

SEQ ID NO: 102868 - RNA, 1701 nt, Artificial Sequence; identical to SEQ ID NO: 101506
  derived and/or modified sequence opt2 from hemagglutinin__InfluenzaA__AHL95032

SEQ ID NO: 102869 - RNA, 1701 nt, Artificial Sequence; identical to SEQ ID NO: 101380
  derived and/or modified sequence opt2 from hemagglutinin__InfluenzaA__AHL95044

SEQ ID NO: 102870 - RNA, 1701 nt, Artificial Sequence; identical to SEQ ID NO: 101370
  derived and/or modified sequence opt2 from hemagglutinin__InfluenzaA__AHL95056

SEQ ID NO: 102871 - RNA, 1701 nt, Artificial Sequence; identical to SEQ ID NO: 101509
  derived and/or modified sequence opt2 from hemagglutinin__InfluenzaA__AHL95068

SEQ ID NO: 102872 - RNA, 1701 nt, Artificial Sequence; identical to SEQ ID NO: 102057
  derived and/or modified sequence opt2 from hemagglutinin__InfluenzaA__AHL95080

SEQ ID NO: 102873 - RNA, 1701 nt, Artificial Sequence; identical to SEQ ID NO: 101380
  derived and/or modified sequence opt2 from hemagglutinin__InfluenzaA__AHL95092

SEQ ID NO: 102874 - RNA, 1701 nt, Artificial Sequence
  derived and/or modified sequence opt2 from hemagglutinin__InfluenzaA__AHL95104
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcaugcgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102875 - RNA, 1701 nt, Artificial Sequence
  derived and/or modified sequence opt2 from hemagglutinin__InfluenzaA__AHL95116
augaagaccaucaucgcccucuccuacauccucugccucgucuucgcccaggagcuccccggcaacgacgacuccaccgccacccucugccucggccacuacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgccaaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102876 - RNA, 1701 nt, Artificial Sequence; identical to SEQ ID NO: 101347
  derived and/or modified sequence opt2 from hemagglutinin__InfluenzaA__AHL95128

SEQ ID NO: 102877 - RNA, 1701 nt, Artificial Sequence; identical to SEQ ID NO: 101370
  derived and/or modified sequence opt2 from hemagglutinin__InfluenzaA__AHL95140

SEQ ID NO: 102878 - RNA, 1701 nt, Artificial Sequence; identical to SEQ ID NO: 101380
  derived and/or modified sequence opt2 from hemagglutinin__InfluenzaA__AHL95152

SEQ ID NO: 102879 - RNA, 1701 nt, Artificial Sequence; identical to SEQ ID NO: 101347
  derived and/or modified sequence opt2 from hemagglutinin__InfluenzaA__AHL95164

SEQ ID NO: 102880 - RNA, 1701 nt, Artificial Sequence; identical to SEQ ID NO: 101380
  derived and/or modified sequence opt2 from hemagglutinin__InfluenzaA__AHL95176

SEQ ID NO: 102881 - RNA, 1701 nt, Artificial Sequence; identical to SEQ ID NO: 101380
  derived and/or modified sequence opt2 from hemagglutinin__InfluenzaA__AHL95188

SEQ ID NO: 102882 - RNA, 1701 nt, Artificial Sequence; identical to SEQ ID NO: 101506
  derived and/or modified sequence opt2 from hemagglutinin__InfluenzaA__AHL95200

SEQ ID NO: 102883 - RNA, 1701 nt, Artificial Sequence; identical to SEQ ID NO: 101380
  derived and/or modified sequence opt2 from hemagglutinin__InfluenzaA__AHL95212

SEQ ID NO: 102884 - RNA, 1701 nt, Artificial Sequence; identical to SEQ ID NO: 101370
  derived and/or modified sequence opt2 from hemagglutinin__InfluenzaA__AHL95224

SEQ ID NO: 102885 - RNA, 1701 nt, Artificial Sequence; identical to SEQ ID NO: 101370
  derived and/or modified sequence opt2 from hemagglutinin__InfluenzaA__AHL95236

SEQ ID NO: 102886 - RNA, 1701 nt, Artificial Sequence; identical to SEQ ID NO: 101395
  derived and/or modified sequence opt2 from hemagglutinin__InfluenzaA__AHL95248

SEQ ID NO: 102887 - RNA, 1701 nt, Artificial Sequence
  derived and/or modified sequence opt2 from hemagglutinin__InfluenzaA__AHL95260
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucuccgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102888 - RNA, 1701 nt, Artificial Sequence; identical to SEQ ID NO: 101380
  derived and/or modified sequence opt2 from hemagglutinin__InfluenzaA__AHL95272

SEQ ID NO: 102889 - RNA, 1701 nt, Artificial Sequence; identical to SEQ ID NO: 101506
  derived and/or modified sequence opt2 from hemagglutinin__InfluenzaA__AHL95284

SEQ ID NO: 102890 - RNA, 1701 nt, Artificial Sequence
  derived and/or modified sequence opt2 from hemagglutinin__InfluenzaA__AHL95296
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagauguuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccuccaaguacuccaagaaguucaagcccgagaucgccauccgccccaagguccgcgaccaggagggccgcaugaacuacuacuggacccucaucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaaggacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 102891 - RNA, 1701 nt, Artificial Sequence; identical to SEQ ID NO: 101347
  derived and/or modified sequence opt2 from hemagglutinin__InfluenzaA__AHL95307

SEQ ID NO: 102892 - RNA, 1701 nt, Artificial Sequence; identical to SEQ ID NO: 101370
  derived and/or modified sequence opt2 from hemagglutinin__InfluenzaA__AHL95319

SEQ ID NO: 102893 - RNA, 1701 nt, Artificial Sequence
  derived and/or modified sequence opt2 from hemagglutinin__InfluenzaA__AHL95331
augaagaccaucaucgcccucuccuacauccucugccucgucuucgcccagaagcuccccggcgacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102894 - RNA, 1701 nt, Artificial Sequence
  derived and/or modified sequence opt2 from hemagglutinin__InfluenzaA__AHL95343
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagauccgcggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102895 - RNA, 1701 nt, Artificial Sequence; identical to SEQ ID NO: 101370
  derived and/or modified sequence opt2 from hemagglutinin__InfluenzaA__AHL95432

SEQ ID NO: 102896 - RNA, 1701 nt, Artificial Sequence; identical to SEQ ID NO: 101506
  derived and/or modified sequence opt2 from hemagglutinin__InfluenzaA__AHL95444

SEQ ID NO: 102897 - RNA, 1701 nt, Artificial Sequence; identical to SEQ ID NO: 101370
  derived and/or modified sequence opt2 from hemagglutinin__InfluenzaA__AHL95457

SEQ ID NO: 102898 - RNA, 1701 nt, Artificial Sequence
  derived and/or modified sequence opt2 from hemagglutinin__InfluenzaA__AHL95470
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucaagcagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucguccgccccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102899 - RNA, 1701 nt, Artificial Sequence; identical to SEQ ID NO: 101506
  derived and/or modified sequence opt2 from hemagglutinin__InfluenzaA__AHL95482

SEQ ID NO: 102900 - RNA, 1701 nt, Artificial Sequence; identical to SEQ ID NO: 101506
  derived and/or modified sequence opt2 from hemagglutinin__InfluenzaA__AHL95494

SEQ ID NO: 102901 - RNA, 1701 nt, Artificial Sequence
  derived and/or modified sequence opt2 from hemagglutinin__InfluenzaA__AHL95506
augaagaccaucaucgcccucuccuacauccucugccucgucuucgcccagaagcuccccggcaacgacaacuccaccgccacccucugccucggccaccacgccguccccaacggcaccaucguccgcaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102902 - RNA, 1701 nt, Artificial Sequence
  derived and/or modified sequence opt2 from hemagglutinin__InfluenzaA__AHL95518
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacguccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102903 - RNA, 1701 nt, Artificial Sequence; identical to SEQ ID NO: 101380
  derived and/or modified sequence opt2 from hemagglutinin__InfluenzaA__AHL95530

SEQ ID NO: 102904 - RNA, 1701 nt, Artificial Sequence; identical to SEQ ID NO: 101380
  derived and/or modified sequence opt2 from hemagglutinin__InfluenzaA__AHL95542

SEQ ID NO: 102905 - RNA, 1701 nt, Artificial Sequence
  derived and/or modified sequence opt2 from hemagglutinin__InfluenzaA__AHL95554
augaagaccaucaucgcccucuccuacauccucugccucgucuucgcccagaagcuccccggcaacgacaacuccauggccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102906 - RNA, 1701 nt, Artificial Sequence
  derived and/or modified sequence opt2 from hemagglutinin__InfluenzaA__AHL95566
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccgcuccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102907 - RNA, 1701 nt, Artificial Sequence
  derived and/or modified sequence opt2 from hemagglutinin__InfluenzaA__AHL95578
augaagaccaucaucgcccucuccuacauccucugccucgucuucgcccagaagcuccccggcaacgacgacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102908 - RNA, 1701 nt, Artificial Sequence
  derived and/or modified sequence opt2 from hemagglutinin__InfluenzaA__AHL95590
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccuccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102909 - RNA, 1701 nt, Artificial Sequence; identical to SEQ ID NO: 101380
  derived and/or modified sequence opt2 from hemagglutinin__InfluenzaA__AHL95602

SEQ ID NO: 102910 - RNA, 1701 nt, Artificial Sequence; identical to SEQ ID NO: 101380
  derived and/or modified sequence opt2 from hemagglutinin__InfluenzaA__AHL95614

SEQ ID NO: 102911 - RNA, 1701 nt, Artificial Sequence
  derived and/or modified sequence opt2 from hemagglutinin__InfluenzaA__AHL95626
augaagaccaucaucgcccucuccuacguccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102912 - RNA, 1701 nt, Artificial Sequence; identical to SEQ ID NO: 101380
  derived and/or modified sequence opt2 from hemagglutinin__InfluenzaA__AHL95638

SEQ ID NO: 102913 - RNA, 1701 nt, Artificial Sequence; identical to SEQ ID NO: 101380
  derived and/or modified sequence opt2 from hemagglutinin__InfluenzaA__AHL95650

SEQ ID NO: 102914 - RNA, 1701 nt, Artificial Sequence
  derived and/or modified sequence opt2 from hemagglutinin__InfluenzaA__AHL95662
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucacccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102915 - RNA, 1701 nt, Artificial Sequence; identical to SEQ ID NO: 101506
  derived and/or modified sequence opt2 from hemagglutinin__InfluenzaA__AHL95686

SEQ ID NO: 102916 - RNA, 1701 nt, Artificial Sequence; identical to SEQ ID NO: 101506
  derived and/or modified sequence opt2 from hemagglutinin__InfluenzaA__AHL95698

SEQ ID NO: 102917 - RNA, 1701 nt, Artificial Sequence; identical to SEQ ID NO: 101380
  derived and/or modified sequence opt2 from hemagglutinin__InfluenzaA__AHL95710

SEQ ID NO: 102918 - RNA, 1701 nt, Artificial Sequence; identical to SEQ ID NO: 102894
  derived and/or modified sequence opt2 from hemagglutinin__InfluenzaA__AHL95722

SEQ ID NO: 102919 - RNA, 1701 nt, Artificial Sequence; identical to SEQ ID NO: 101370
  derived and/or modified sequence opt2 from hemagglutinin__InfluenzaA__AHL95734

SEQ ID NO: 102920 - RNA, 1701 nt, Artificial Sequence; identical to SEQ ID NO: 101370
  derived and/or modified sequence opt2 from hemagglutinin__InfluenzaA__AHL95746

SEQ ID NO: 102921 - RNA, 1701 nt, Artificial Sequence; identical to SEQ ID NO: 101509
  derived and/or modified sequence opt2 from hemagglutinin__InfluenzaA__AHL95758

SEQ ID NO: 102922 - RNA, 1701 nt, Artificial Sequence; identical to SEQ ID NO: 101380
  derived and/or modified sequence opt2 from hemagglutinin__InfluenzaA__AHL95770

SEQ ID NO: 102923 - RNA, 1701 nt, Artificial Sequence
  derived and/or modified sequence opt2 from hemagglutinin__InfluenzaA__AHL95782
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcaacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102924 - RNA, 1701 nt, Artificial Sequence
  derived and/or modified sequence opt2 from hemagglutinin__InfluenzaA__AHL95794
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcaacaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102925 - RNA, 1701 nt, Artificial Sequence
  derived and/or modified sequence opt2 from hemagglutinin__InfluenzaA__AHL95806
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuccaucaugugggccugccagaagggcaacauccgcugcaacaucugcaucuga

SEQ ID NO: 102926 - RNA, 1701 nt, Artificial Sequence; identical to SEQ ID NO: 101506
  derived and/or modified sequence opt2 from hemagglutinin__InfluenzaA__AHL95818

SEQ ID NO: 102927 - RNA, 1701 nt, Artificial Sequence; identical to SEQ ID NO: 101370
  derived and/or modified sequence opt2 from hemagglutinin__InfluenzaA__AHL95830

SEQ ID NO: 102928 - RNA, 1701 nt, Artificial Sequence; identical to SEQ ID NO: 101506
  derived and/or modified sequence opt2 from hemagglutinin__InfluenzaA__AHL95842

SEQ ID NO: 102929 - RNA, 1701 nt, Artificial Sequence; identical to SEQ ID NO: 101370
  derived and/or modified sequence opt2 from hemagglutinin__InfluenzaA__AHL95854

SEQ ID NO: 102930 - RNA, 1701 nt, Artificial Sequence; identical to SEQ ID NO: 101380
  derived and/or modified sequence opt2 from hemagglutinin__InfluenzaA__AHL95866

SEQ ID NO: 102931 - RNA, 1701 nt, Artificial Sequence
  derived and/or modified sequence opt2 from hemagglutinin__InfluenzaA__AHL95878
augaaggccauccucgucaucaugcucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucuccccccuccaccucggcaagugcaacaucgccggcuggauccucggcaaccccgagugcgagucccucuccaccgccuccuccugguccuacaucgucgagaccuccggcuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaucuccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 102932 - RNA, 1701 nt, Artificial Sequence; identical to SEQ ID NO: 101380
  derived and/or modified sequence opt2 from hemagglutinin__InfluenzaA__AHL95889

SEQ ID NO: 102933 - RNA, 1701 nt, Artificial Sequence; identical to SEQ ID NO: 101506
  derived and/or modified sequence opt2 from hemagglutinin__InfluenzaA__AHL95901

SEQ ID NO: 102934 - RNA, 1701 nt, Artificial Sequence; identical to SEQ ID NO: 101506
  derived and/or modified sequence opt2 from hemagglutinin__InfluenzaA__AHL95913

SEQ ID NO: 102935 - RNA, 1701 nt, Artificial Sequence
  derived and/or modified sequence opt2 from hemagglutinin__InfluenzaA__AHL95937
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaccgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102936 - RNA, 1701 nt, Artificial Sequence
  derived and/or modified sequence opt2 from hemagglutinin__InfluenzaA__AHL95949
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccacuccaacuucaaguaccccgcccucaacaugaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102937 - RNA, 1701 nt, Artificial Sequence; identical to SEQ ID NO: 101380
  derived and/or modified sequence opt2 from hemagglutinin__InfluenzaA__AHL95961

SEQ ID NO: 102938 - RNA, 1701 nt, Artificial Sequence; identical to SEQ ID NO: 101380
  derived and/or modified sequence opt2 from hemagglutinin__InfluenzaA__AHL95973

SEQ ID NO: 102939 - RNA, 1701 nt, Artificial Sequence; identical to SEQ ID NO: 101380
  derived and/or modified sequence opt2 from hemagglutinin__InfluenzaA__AHL95985

SEQ ID NO: 102940 - RNA, 1701 nt, Artificial Sequence
  derived and/or modified sequence opt2 from hemagglutinin__InfluenzaA__AHL95997
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccuccugcauccgcggcuccaaguccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102941 - RNA, 1701 nt, Artificial Sequence
  derived and/or modified sequence opt2 from hemagglutinin__InfluenzaA__AHL96021
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaaguccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102942 - RNA, 1701 nt, Artificial Sequence; identical to SEQ ID NO: 101380
  derived and/or modified sequence opt2 from hemagglutinin__InfluenzaA__AHL96033

SEQ ID NO: 102943 - RNA, 1701 nt, Artificial Sequence; identical to SEQ ID NO: 101635
  derived and/or modified sequence opt2 from hemagglutinin__InfluenzaA__AHL96045

SEQ ID NO: 102944 - RNA, 1701 nt, Artificial Sequence; identical to SEQ ID NO: 101506
  derived and/or modified sequence opt2 from hemagglutinin__InfluenzaA__AHL96056

SEQ ID NO: 102945 - RNA, 1701 nt, Artificial Sequence; identical to SEQ ID NO: 101370
  derived and/or modified sequence opt2 from hemagglutinin__InfluenzaA__AHL96068

SEQ ID NO: 102946 - RNA, 1701 nt, Artificial Sequence; identical to SEQ ID NO: 101380
  derived and/or modified sequence opt2 from hemagglutinin__InfluenzaA__AHL96080

SEQ ID NO: 102947 - RNA, 1701 nt, Artificial Sequence
  derived and/or modified sequence opt2 from hemagglutinin__InfluenzaA__AHL96092
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucaucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102948 - RNA, 1701 nt, Artificial Sequence
  derived and/or modified sequence opt2 from hemagglutinin__InfluenzaA__AHL96104
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagcgccagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102949 - RNA, 1701 nt, Artificial Sequence; identical to SEQ ID NO: 101994
  derived and/or modified sequence opt2 from hemagglutinin__InfluenzaA__AHL96116

SEQ ID NO: 102950 - RNA, 1701 nt, Artificial Sequence; identical to SEQ ID NO: 101370
  derived and/or modified sequence opt2 from hemagglutinin__InfluenzaA__AHL96128

SEQ ID NO: 102951 - RNA, 1701 nt, Artificial Sequence; identical to SEQ ID NO: 101506
  derived and/or modified sequence opt2 from hemagglutinin__InfluenzaA__AHL96152

SEQ ID NO: 102952 - RNA, 1701 nt, Artificial Sequence
  derived and/or modified sequence opt2 from hemagglutinin__InfluenzaA__AHL96164
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaagaacuggauccucuggaucuccuucgccaucuccugcuuccuccucugcgucgcccuccucggcuucaucaugugggccugccagaagggcaacauccgcugcaacaucugcaucuga

SEQ ID NO: 102953 - RNA, 1701 nt, Artificial Sequence; identical to SEQ ID NO: 101506
  derived and/or modified sequence opt2 from hemagglutinin__InfluenzaA__AHL96176

SEQ ID NO: 102954 - RNA, 1701 nt, Artificial Sequence; identical to SEQ ID NO: 101506
  derived and/or modified sequence opt2 from hemagglutinin__InfluenzaA__AHL96188

SEQ ID NO: 102955 - RNA, 1701 nt, Artificial Sequence
  derived and/or modified sequence opt2 from hemagglutinin__InfluenzaA__AHL96200
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagguccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102956 - RNA, 1701 nt, Artificial Sequence; identical to SEQ ID NO: 101370
  derived and/or modified sequence opt2 from hemagglutinin__InfluenzaA__AHL96212

SEQ ID NO: 102957 - RNA, 1701 nt, Artificial Sequence; identical to SEQ ID NO: 101979
  derived and/or modified sequence opt2 from hemagglutinin__InfluenzaA__AHL96224

SEQ ID NO: 102958 - RNA, 1701 nt, Artificial Sequence
  derived and/or modified sequence opt2 from hemagglutinin__InfluenzaA__AHL96236
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaugggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucgaguccauccgcaacggcaccuacgaccacgacgucuaccgcgacgaggcccucaacaaccgcuuccagaucaagggcgucgagcucaaguccggcuacaagaacuggauccucuggaucuccuucgccaucuccugcuuccuccucugcgucgcccuccucggcuucaucaugugggccugccagaagggcaacauccgcugcaacaucugcaucuga

SEQ ID NO: 102959 - RNA, 1701 nt, Artificial Sequence
  derived and/or modified sequence opt2 from hemagglutinin__InfluenzaA__AHL96248
augaagaccaucaucgcccucggcuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucaucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102960 - RNA, 1701 nt, Artificial Sequence; identical to SEQ ID NO: 101506
  derived and/or modified sequence opt2 from hemagglutinin__InfluenzaA__AHL96260

SEQ ID NO: 102961 - RNA, 1701 nt, Artificial Sequence; identical to SEQ ID NO: 101370
  derived and/or modified sequence opt2 from hemagglutinin__InfluenzaA__AHL96274

SEQ ID NO: 102962 - RNA, 1701 nt, Artificial Sequence; identical to SEQ ID NO: 101506
  derived and/or modified sequence opt2 from hemagglutinin__InfluenzaA__AHL96304

SEQ ID NO: 102963 - RNA, 1701 nt, Artificial Sequence; identical to SEQ ID NO: 101347
  derived and/or modified sequence opt2 from hemagglutinin__InfluenzaA__AHL96318

SEQ ID NO: 102964 - RNA, 1701 nt, Artificial Sequence; identical to SEQ ID NO: 101506
  derived and/or modified sequence opt2 from hemagglutinin__InfluenzaA__AHL96330

SEQ ID NO: 102965 - RNA, 1701 nt, Artificial Sequence; identical to SEQ ID NO: 101509
  derived and/or modified sequence opt2 from hemagglutinin__InfluenzaA__AHL96342

SEQ ID NO: 102966 - RNA, 1701 nt, Artificial Sequence
  derived and/or modified sequence opt2 from hemagglutinin__InfluenzaA__AHL96354
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccucaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102967 - RNA, 1701 nt, Artificial Sequence
  derived and/or modified sequence opt2 from hemagglutinin__InfluenzaA__AHL96366
augaagaccaucaucgcccucuccuacauccucugccucgucuucgcccagaagcuccccgagaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102968 - RNA, 1701 nt, Artificial Sequence; identical to SEQ ID NO: 101380
  derived and/or modified sequence opt2 from hemagglutinin__InfluenzaA__AHL96378

SEQ ID NO: 102969 - RNA, 1701 nt, Artificial Sequence; identical to SEQ ID NO: 101370
  derived and/or modified sequence opt2 from hemagglutinin__InfluenzaA__AHL96390

SEQ ID NO: 102970 - RNA, 1701 nt, Artificial Sequence
  derived and/or modified sequence opt2 from hemagglutinin__InfluenzaA__AHL96402
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacaagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102971 - RNA, 1701 nt, Artificial Sequence; identical to SEQ ID NO: 101380
  derived and/or modified sequence opt2 from hemagglutinin__InfluenzaA__AHL96414

SEQ ID NO: 102972 - RNA, 1701 nt, Artificial Sequence; identical to SEQ ID NO: 101506
  derived and/or modified sequence opt2 from hemagglutinin__InfluenzaA__AHL96426

SEQ ID NO: 102973 - RNA, 1701 nt, Artificial Sequence
  derived and/or modified sequence opt2 from hemagglutinin__InfluenzaA__AHL96438
augaagaccaucaucgcccucuccuacauccucugccucgucuucgcccaggagcuccccggcaacgacgacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcuccuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102974 - RNA, 1701 nt, Artificial Sequence; identical to SEQ ID NO: 101380
  derived and/or modified sequence opt2 from hemagglutinin__InfluenzaA__AHL96450

SEQ ID NO: 102975 - RNA, 1701 nt, Artificial Sequence; identical to SEQ ID NO: 101506
  derived and/or modified sequence opt2 from hemagglutinin__InfluenzaA__AHL96462

SEQ ID NO: 102976 - RNA, 1701 nt, Artificial Sequence
  derived and/or modified sequence opt2 from hemagglutinin__InfluenzaA__AHL96474
augaaggccauccucgucgucaugcucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucuccccccuccaccucggcaagugcaacaucgccggcuggauccucggcaaccccgagugcgagucccucuccaccgccuccuccugguccuacaucgucgagaccuccggcuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaucuccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 102977 - RNA, 1701 nt, Artificial Sequence
  derived and/or modified sequence opt2 from hemagglutinin__InfluenzaA__AHL96485
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugaaguccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102978 - RNA, 1701 nt, Artificial Sequence; identical to SEQ ID NO: 101506
  derived and/or modified sequence opt2 from hemagglutinin__InfluenzaA__AHL96497

SEQ ID NO: 102979 - RNA, 1701 nt, Artificial Sequence; identical to SEQ ID NO: 101380
  derived and/or modified sequence opt2 from hemagglutinin__InfluenzaA__AHL96509

SEQ ID NO: 102980 - RNA, 1701 nt, Artificial Sequence; identical to SEQ ID NO: 101347
  derived and/or modified sequence opt2 from hemagglutinin__InfluenzaA__AHL96521

SEQ ID NO: 102981 - RNA, 1701 nt, Artificial Sequence; identical to SEQ ID NO: 101506
  derived and/or modified sequence opt2 from hemagglutinin__InfluenzaA__AHL96533

SEQ ID NO: 102982 - RNA, 1701 nt, Artificial Sequence; identical to SEQ ID NO: 101370
  derived and/or modified sequence opt2 from hemagglutinin__InfluenzaA__AHL96545

SEQ ID NO: 102983 - RNA, 1701 nt, Artificial Sequence
  derived and/or modified sequence opt2 from hemagglutinin__InfluenzaA__AHL96569
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcgucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102984 - RNA, 1701 nt, Artificial Sequence; identical to SEQ ID NO: 102976
  derived and/or modified sequence opt2 from hemagglutinin__InfluenzaA__AHL96581

SEQ ID NO: 102985 - RNA, 1701 nt, Artificial Sequence
  derived and/or modified sequence opt2 from hemagglutinin__InfluenzaA__AHL96592
augaagaccaucaucgcccucggcuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucaucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102986 - RNA, 1701 nt, Artificial Sequence; identical to SEQ ID NO: 101506
  derived and/or modified sequence opt2 from hemagglutinin__InfluenzaA__AHL96604

SEQ ID NO: 102987 - RNA, 1701 nt, Artificial Sequence; identical to SEQ ID NO: 101506
  derived and/or modified sequence opt2 from hemagglutinin__InfluenzaA__AHL96616

SEQ ID NO: 102988 - RNA, 1701 nt, Artificial Sequence
  derived and/or modified sequence opt2 from hemagglutinin__InfluenzaA__AHL96628
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcuggggcggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102989 - RNA, 1701 nt, Artificial Sequence; identical to SEQ ID NO: 102977
  derived and/or modified sequence opt2 from hemagglutinin__InfluenzaA__AHL96640

SEQ ID NO: 102990 - RNA, 1701 nt, Artificial Sequence
  derived and/or modified sequence opt2 from hemagglutinin__InfluenzaA__AHL96652
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccaggacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102991 - RNA, 1701 nt, Artificial Sequence; identical to SEQ ID NO: 101979
  derived and/or modified sequence opt2 from hemagglutinin__InfluenzaA__AHL96664

SEQ ID NO: 102992 - RNA, 1701 nt, Artificial Sequence
  derived and/or modified sequence opt2 from hemagglutinin__InfluenzaA__AHL96676
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaucgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 102993 - RNA, 1701 nt, Artificial Sequence; identical to SEQ ID NO: 101506
  derived and/or modified sequence opt2 from hemagglutinin__InfluenzaA__AHL96688

SEQ ID NO: 102994 - RNA, 1701 nt, Artificial Sequence; identical to SEQ ID NO: 101506
  derived and/or modified sequence opt2 from hemagglutinin__InfluenzaA__AHL96700

SEQ ID NO: 102995 - RNA, 1701 nt, Artificial Sequence; identical to SEQ ID NO: 101506
  derived and/or modified sequence opt2 from hemagglutinin__InfluenzaA__AHL96712

SEQ ID NO: 102996 - RNA, 1701 nt, Artificial Sequence; identical to SEQ ID NO: 101380
  derived and/or modified sequence opt2 from hemagglutinin__InfluenzaA__AHL96724

SEQ ID NO: 102997 - RNA, 1701 nt, Artificial Sequence; identical to SEQ ID NO: 101370
  derived and/or modified sequence opt2 from hemagglutinin__InfluenzaA__AHL96748

SEQ ID NO: 102998 - RNA, 1701 nt, Artificial Sequence; identical to SEQ ID NO: 101380
  derived and/or modified sequence opt2 from hemagglutinin__InfluenzaA__AHL96784

SEQ ID NO: 102999 - RNA, 1701 nt, Artificial Sequence
  derived and/or modified sequence opt2 from hemagglutinin__InfluenzaA__AHL96796
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucaucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103000 - RNA, 1701 nt, Artificial Sequence; identical to SEQ ID NO: 101370
  derived and/or modified sequence opt2 from hemagglutinin__InfluenzaA__AHL96808

SEQ ID NO: 103001 - RNA, 1701 nt, Artificial Sequence; identical to SEQ ID NO: 101370
  derived and/or modified sequence opt2 from hemagglutinin__InfluenzaA__AHL96820

SEQ ID NO: 103002 - RNA, 1701 nt, Artificial Sequence; identical to SEQ ID NO: 101380
  derived and/or modified sequence opt2 from hemagglutinin__InfluenzaA__AHL96832

SEQ ID NO: 103003 - RNA, 1701 nt, Artificial Sequence; identical to SEQ ID NO: 101380
  derived and/or modified sequence opt2 from hemagglutinin__InfluenzaA__AHL96844

SEQ ID NO: 103004 - RNA, 1701 nt, Artificial Sequence; identical to SEQ ID NO: 101380
  derived and/or modified sequence opt2 from hemagglutinin__InfluenzaA__AHL96856

SEQ ID NO: 103005 - RNA, 1701 nt, Artificial Sequence
  derived and/or modified sequence opt2 from hemagglutinin__InfluenzaA__AHL96868
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcggcaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucguccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccauguccugcuuccuccucugcgucgcccuccucggcuucaucaugugggccugccagaagggcaacauccgcugcaacaucugcaucuga

SEQ ID NO: 103006 - RNA, 1701 nt, Artificial Sequence; identical to SEQ ID NO: 101370
  derived and/or modified sequence opt2 from hemagglutinin__InfluenzaA__AHL96880

SEQ ID NO: 103007 - RNA, 1701 nt, Artificial Sequence
  derived and/or modified sequence opt2 from hemagglutinin__InfluenzaA__AHL96892
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcguccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103008 - RNA, 1701 nt, Artificial Sequence
  derived and/or modified sequence opt2 from hemagglutinin__InfluenzaA__AHL96904
augaagaccaucaucgcccucuccuacauccucugccucgucuucgcccagaagcuccccggcaacgacaacuccaccgccacccucugccucggccaccacgccguccccaacggcaugaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucguccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccauguccugcuuccuccucugcgucgcccuccucggcuccaucaugugggccugccagaagggcaacauccgcugcaacaucugcaucuga

SEQ ID NO: 103009 - RNA, 1701 nt, Artificial Sequence; identical to SEQ ID NO: 101370
  derived and/or modified sequence opt2 from hemagglutinin__InfluenzaA__AHL96916

SEQ ID NO: 103010 - RNA, 1701 nt, Artificial Sequence; identical to SEQ ID NO: 101370
  derived and/or modified sequence opt2 from hemagglutinin__InfluenzaA__AHL96928

SEQ ID NO: 103011 - RNA, 1701 nt, Artificial Sequence; identical to SEQ ID NO: 101370
  derived and/or modified sequence opt2 from hemagglutinin__InfluenzaA__AHL96940

SEQ ID NO: 103012 - RNA, 1701 nt, Artificial Sequence; identical to SEQ ID NO: 101380
  derived and/or modified sequence opt2 from hemagglutinin__InfluenzaA__AHL96952

SEQ ID NO: 103013 - RNA, 1701 nt, Artificial Sequence; identical to SEQ ID NO: 101380
  derived and/or modified sequence opt2 from hemagglutinin__InfluenzaA__AHL96964

SEQ ID NO: 103014 - RNA, 1701 nt, Artificial Sequence; identical to SEQ ID NO: 101538
  derived and/or modified sequence opt2 from hemagglutinin__InfluenzaA__AHL96976

SEQ ID NO: 103015 - RNA, 1701 nt, Artificial Sequence
  derived and/or modified sequence opt2 from hemagglutinin__InfluenzaA__AHL96988
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucguccgccccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103016 - RNA, 1701 nt, Artificial Sequence; identical to SEQ ID NO: 101380
  derived and/or modified sequence opt2 from hemagglutinin__InfluenzaA__AHL97000

SEQ ID NO: 103017 - RNA, 1701 nt, Artificial Sequence; identical to SEQ ID NO: 101506
  derived and/or modified sequence opt2 from hemagglutinin__InfluenzaA__AHL97012

SEQ ID NO: 103018 - RNA, 1701 nt, Artificial Sequence
  derived and/or modified sequence opt2 from hemagglutinin__InfluenzaA__AHL97024
augaagaccaucaucgcccucuccuacauccucugccucgucuucgcccagaagcuccccggcaacgacaacuccaccgccacccucugccucggccaccacgccguccccaacggcaccaucgucaagaccaucaugaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103019 - RNA, 1701 nt, Artificial Sequence
  derived and/or modified sequence opt2 from hemagglutinin__InfluenzaA__AHL97036
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacaccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103020 - RNA, 1701 nt, Artificial Sequence; identical to SEQ ID NO: 101395
  derived and/or modified sequence opt2 from hemagglutinin__InfluenzaA__AHL97048

SEQ ID NO: 103021 - RNA, 1701 nt, Artificial Sequence
  derived and/or modified sequence opt2 from hemagglutinin__InfluenzaA__AHL97060
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgagcacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103022 - RNA, 1701 nt, Artificial Sequence; identical to SEQ ID NO: 101506
  derived and/or modified sequence opt2 from hemagglutinin__InfluenzaA__AHL97072

SEQ ID NO: 103023 - RNA, 1701 nt, Artificial Sequence; identical to SEQ ID NO: 101506
  derived and/or modified sequence opt2 from hemagglutinin__InfluenzaA__AHL97084

SEQ ID NO: 103024 - RNA, 1701 nt, Artificial Sequence; identical to SEQ ID NO: 101347
  derived and/or modified sequence opt2 from hemagglutinin__InfluenzaA__AHL97096

SEQ ID NO: 103025 - RNA, 1701 nt, Artificial Sequence; identical to SEQ ID NO: 101509
  derived and/or modified sequence opt2 from hemagglutinin__InfluenzaA__AHL97108

SEQ ID NO: 103026 - RNA, 1701 nt, Artificial Sequence
  derived and/or modified sequence opt2 from hemagglutinin__InfluenzaA__AHL97120
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcgucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccaucaucaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103027 - RNA, 1701 nt, Artificial Sequence
  derived and/or modified sequence opt2 from hemagglutinin__InfluenzaA__AHL97132
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccggcaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103028 - RNA, 1701 nt, Artificial Sequence; identical to SEQ ID NO: 101506
  derived and/or modified sequence opt2 from hemagglutinin__InfluenzaA__AHL97144

SEQ ID NO: 103029 - RNA, 1701 nt, Artificial Sequence; identical to SEQ ID NO: 101506
  derived and/or modified sequence opt2 from hemagglutinin__InfluenzaA__AHL97156

SEQ ID NO: 103030 - RNA, 1701 nt, Artificial Sequence; identical to SEQ ID NO: 101506
  derived and/or modified sequence opt2 from hemagglutinin__InfluenzaA__AHL97168

SEQ ID NO: 103031 - RNA, 1701 nt, Artificial Sequence; identical to SEQ ID NO: 101380
  derived and/or modified sequence opt2 from hemagglutinin__InfluenzaA__AHL97180

SEQ ID NO: 103032 - RNA, 1701 nt, Artificial Sequence; identical to SEQ ID NO: 101506
  derived and/or modified sequence opt2 from hemagglutinin__InfluenzaA__AHL97192

SEQ ID NO: 103033 - RNA, 1701 nt, Artificial Sequence; identical to SEQ ID NO: 101506
  derived and/or modified sequence opt2 from hemagglutinin__InfluenzaA__AHL97204

SEQ ID NO: 103034 - RNA, 1701 nt, Artificial Sequence; identical to SEQ ID NO: 101506
  derived and/or modified sequence opt2 from hemagglutinin__InfluenzaA__AHL97216

SEQ ID NO: 103035 - RNA, 1701 nt, Artificial Sequence
  derived and/or modified sequence opt2 from hemagglutinin__InfluenzaA__AHL97228
augaagaccaucaucgcccucuccuacauccucugccucgucuucgcccagaagcuccccggcaacgacaacuccaccgccacccucugccucggccaccacgccguccccaacggcaccgucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 103036 - RNA, 1701 nt, Artificial Sequence; identical to SEQ ID NO: 101506
  derived and/or modified sequence opt2 from hemagglutinin__InfluenzaA__AHL97240

SEQ ID NO: 103037 - RNA, 1701 nt, Artificial Sequence
  derived and/or modified sequence opt2 from hemagglutinin__InfluenzaA__AHL97252
augaagaccaucaucgcccucuccuacauccucugccucgucuucgcccaggagcuccccggcaacgacgacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgagaacuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103038 - RNA, 1701 nt, Artificial Sequence; identical to SEQ ID NO: 101370
  derived and/or modified sequence opt2 from hemagglutinin__InfluenzaA__AHL97264

SEQ ID NO: 103039 - RNA, 1701 nt, Artificial Sequence; identical to SEQ ID NO: 101506
  derived and/or modified sequence opt2 from hemagglutinin__InfluenzaA__AHL97276

SEQ ID NO: 103040 - RNA, 1701 nt, Artificial Sequence
  derived and/or modified sequence opt2 from hemagglutinin__InfluenzaA__AHL97288
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcaacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaucaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103041 - RNA, 1701 nt, Artificial Sequence; identical to SEQ ID NO: 101380
  derived and/or modified sequence opt2 from hemagglutinin__InfluenzaA__AHL97300

SEQ ID NO: 103042 - RNA, 1701 nt, Artificial Sequence; identical to SEQ ID NO: 101506
  derived and/or modified sequence opt2 from hemagglutinin__InfluenzaA__AHL97312

SEQ ID NO: 103043 - RNA, 1701 nt, Artificial Sequence; identical to SEQ ID NO: 101506
  derived and/or modified sequence opt2 from hemagglutinin__InfluenzaA__AHL97336

SEQ ID NO: 103044 - RNA, 1701 nt, Artificial Sequence; identical to SEQ ID NO: 101506
  derived and/or modified sequence opt2 from hemagglutinin__InfluenzaA__AHL97348

SEQ ID NO: 103045 - RNA, 1701 nt, Artificial Sequence
  derived and/or modified sequence opt2 from hemagglutinin__InfluenzaA__AHL97372
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaacgccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103046 - RNA, 1701 nt, Artificial Sequence; identical to SEQ ID NO: 101506
  derived and/or modified sequence opt2 from hemagglutinin__InfluenzaA__AHL97384

SEQ ID NO: 103047 - RNA, 1701 nt, Artificial Sequence; identical to SEQ ID NO: 101370
  derived and/or modified sequence opt2 from hemagglutinin__InfluenzaA__AHL97396

SEQ ID NO: 103048 - RNA, 1701 nt, Artificial Sequence; identical to SEQ ID NO: 101347
  derived and/or modified sequence opt2 from hemagglutinin__InfluenzaA__AHL97408

SEQ ID NO: 103049 - RNA, 1701 nt, Artificial Sequence; identical to SEQ ID NO: 103018
  derived and/or modified sequence opt2 from hemagglutinin__InfluenzaA__AHL97420

SEQ ID NO: 103050 - RNA, 1701 nt, Artificial Sequence
  derived and/or modified sequence opt2 from hemagglutinin__InfluenzaA__AHL97444
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcaccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103051 - RNA, 1701 nt, Artificial Sequence; identical to SEQ ID NO: 101380
  derived and/or modified sequence opt2 from hemagglutinin__InfluenzaA__AHL97456

SEQ ID NO: 103052 - RNA, 1701 nt, Artificial Sequence
  derived and/or modified sequence opt2 from hemagglutinin__InfluenzaA__AHL97468
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103053 - RNA, 1701 nt, Artificial Sequence; identical to SEQ ID NO: 101506
  derived and/or modified sequence opt2 from hemagglutinin__InfluenzaA__AHL97480

SEQ ID NO: 103054 - RNA, 1701 nt, Artificial Sequence; identical to SEQ ID NO: 101506
  derived and/or modified sequence opt2 from hemagglutinin__InfluenzaA__AHL97493

SEQ ID NO: 103055 - RNA, 1701 nt, Artificial Sequence; identical to SEQ ID NO: 103018
  derived and/or modified sequence opt2 from hemagglutinin__InfluenzaA__AHL97505

SEQ ID NO: 103056 - RNA, 1701 nt, Artificial Sequence
  derived and/or modified sequence opt2 from hemagglutinin__InfluenzaA__AHL97517
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccacccagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103057 - RNA, 1701 nt, Artificial Sequence; identical to SEQ ID NO: 101395
  derived and/or modified sequence opt2 from hemagglutinin__InfluenzaA__AHL97529

SEQ ID NO: 103058 - RNA, 1701 nt, Artificial Sequence; identical to SEQ ID NO: 101380
  derived and/or modified sequence opt2 from hemagglutinin__InfluenzaA__AHL97541

SEQ ID NO: 103059 - RNA, 1701 nt, Artificial Sequence; identical to SEQ ID NO: 101506
  derived and/or modified sequence opt2 from hemagglutinin__InfluenzaA__AHL97553

SEQ ID NO: 103060 - RNA, 1701 nt, Artificial Sequence; identical to SEQ ID NO: 101347
  derived and/or modified sequence opt2 from hemagglutinin__InfluenzaA__AHL97565

SEQ ID NO: 103061 - RNA, 1701 nt, Artificial Sequence
  derived and/or modified sequence opt2 from hemagglutinin__InfluenzaA__AHL97577
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaagcccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103062 - RNA, 1701 nt, Artificial Sequence; identical to SEQ ID NO: 101535
  derived and/or modified sequence opt2 from hemagglutinin__InfluenzaA__AHL97589

SEQ ID NO: 103063 - RNA, 1701 nt, Artificial Sequence; identical to SEQ ID NO: 101506
  derived and/or modified sequence opt2 from hemagglutinin__InfluenzaA__AHL97601

SEQ ID NO: 103064 - RNA, 1701 nt, Artificial Sequence; identical to SEQ ID NO: 101370
  derived and/or modified sequence opt2 from hemagglutinin__InfluenzaA__AHL97613

SEQ ID NO: 103065 - RNA, 1701 nt, Artificial Sequence; identical to SEQ ID NO: 103052
  derived and/or modified sequence opt2 from hemagglutinin__InfluenzaA__AHL97625

SEQ ID NO: 103066 - RNA, 1701 nt, Artificial Sequence; identical to SEQ ID NO: 101380
  derived and/or modified sequence opt2 from hemagglutinin__InfluenzaA__AHL97637

SEQ ID NO: 103067 - RNA, 1701 nt, Artificial Sequence
  derived and/or modified sequence opt2 from hemagglutinin__InfluenzaA__AHL97661
augaagaccaucaucgcccucggcuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103068 - RNA, 1701 nt, Artificial Sequence
  derived and/or modified sequence opt2 from hemagglutinin__InfluenzaA__AHL97673
augaagaccaccaucgcccucuccuacauccucugccucgucuucgcccaggagcuccccggcaacgacgacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103069 - RNA, 1701 nt, Artificial Sequence; identical to SEQ ID NO: 101506
  derived and/or modified sequence opt2 from hemagglutinin__InfluenzaA__AHL97685

SEQ ID NO: 103070 - RNA, 1701 nt, Artificial Sequence
  derived and/or modified sequence opt2 from hemagglutinin__InfluenzaA__AHL97697
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcggcaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103071 - RNA, 1701 nt, Artificial Sequence; identical to SEQ ID NO: 101380
  derived and/or modified sequence opt2 from hemagglutinin__InfluenzaA__AHL97709

SEQ ID NO: 103072 - RNA, 1701 nt, Artificial Sequence; identical to SEQ ID NO: 101506
  derived and/or modified sequence opt2 from hemagglutinin__InfluenzaA__AHL97721

SEQ ID NO: 103073 - RNA, 1701 nt, Artificial Sequence; identical to SEQ ID NO: 101380
  derived and/or modified sequence opt2 from hemagglutinin__InfluenzaA__AHL97733

SEQ ID NO: 103074 - RNA, 1701 nt, Artificial Sequence; identical to SEQ ID NO: 101370
  derived and/or modified sequence opt2 from hemagglutinin__InfluenzaA__AHL97745

SEQ ID NO: 103075 - RNA, 1701 nt, Artificial Sequence; identical to SEQ ID NO: 101506
  derived and/or modified sequence opt2 from hemagglutinin__InfluenzaA__AHL97757

SEQ ID NO: 103076 - RNA, 1701 nt, Artificial Sequence; identical to SEQ ID NO: 101506
  derived and/or modified sequence opt2 from hemagglutinin__InfluenzaA__AHL97769

SEQ ID NO: 103077 - RNA, 1701 nt, Artificial Sequence
  derived and/or modified sequence opt2 from hemagglutinin__InfluenzaA__AHL97781
augaagaccaucaucgcccucuccuacauccucugccucgucuucgcccaggagcuccccggcaacgacgacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaacuccuccaucaugcgcuccgacgcccccaucggcaagugcaacuccaccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103078 - RNA, 1701 nt, Artificial Sequence; identical to SEQ ID NO: 101506
  derived and/or modified sequence opt2 from hemagglutinin__InfluenzaA__AHL97793

SEQ ID NO: 103079 - RNA, 1701 nt, Artificial Sequence
  derived and/or modified sequence opt2 from hemagglutinin__InfluenzaA__AHL97805
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuacgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103080 - RNA, 1701 nt, Artificial Sequence; identical to SEQ ID NO: 101380
  derived and/or modified sequence opt2 from hemagglutinin__InfluenzaA__AHL97817

SEQ ID NO: 103081 - RNA, 1701 nt, Artificial Sequence; identical to SEQ ID NO: 103070
  derived and/or modified sequence opt2 from hemagglutinin__InfluenzaA__AHL97829

SEQ ID NO: 103082 - RNA, 1701 nt, Artificial Sequence; identical to SEQ ID NO: 101506
  derived and/or modified sequence opt2 from hemagglutinin__InfluenzaA__AHL97841

SEQ ID NO: 103083 - RNA, 1701 nt, Artificial Sequence; identical to SEQ ID NO: 101506
  derived and/or modified sequence opt2 from hemagglutinin__InfluenzaA__AHL97853

SEQ ID NO: 103084 - RNA, 1701 nt, Artificial Sequence; identical to SEQ ID NO: 101506
  derived and/or modified sequence opt2 from hemagglutinin__InfluenzaA__AHL97865

SEQ ID NO: 103085 - RNA, 1701 nt, Artificial Sequence; identical to SEQ ID NO: 101506
  derived and/or modified sequence opt2 from hemagglutinin__InfluenzaA__AHL97877

SEQ ID NO: 103086 - RNA, 1701 nt, Artificial Sequence; identical to SEQ ID NO: 101380
  derived and/or modified sequence opt2 from hemagglutinin__InfluenzaA__AHL97889

SEQ ID NO: 103087 - RNA, 1701 nt, Artificial Sequence; identical to SEQ ID NO: 101380
  derived and/or modified sequence opt2 from hemagglutinin__InfluenzaA__AHL97901

SEQ ID NO: 103088 - RNA, 1701 nt, Artificial Sequence; identical to SEQ ID NO: 101370
  derived and/or modified sequence opt2 from hemagglutinin__InfluenzaA__AHL97913

SEQ ID NO: 103089 - RNA, 1701 nt, Artificial Sequence
  derived and/or modified sequence opt2 from hemagglutinin__InfluenzaA__AHL97925
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcuccuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103090 - RNA, 1701 nt, Artificial Sequence; identical to SEQ ID NO: 101370
  derived and/or modified sequence opt2 from hemagglutinin__InfluenzaA__AHL97937

SEQ ID NO: 103091 - RNA, 1701 nt, Artificial Sequence; identical to SEQ ID NO: 103050
  derived and/or modified sequence opt2 from hemagglutinin__InfluenzaA__AHL97949

SEQ ID NO: 103092 - RNA, 1701 nt, Artificial Sequence; identical to SEQ ID NO: 101380
  derived and/or modified sequence opt2 from hemagglutinin__InfluenzaA__AHL97961

SEQ ID NO: 103093 - RNA, 1701 nt, Artificial Sequence; identical to SEQ ID NO: 101380
  derived and/or modified sequence opt2 from hemagglutinin__InfluenzaA__AHL97973

SEQ ID NO: 103094 - RNA, 1701 nt, Artificial Sequence; identical to SEQ ID NO: 101380
  derived and/or modified sequence opt2 from hemagglutinin__InfluenzaA__AHL97985

SEQ ID NO: 103095 - RNA, 1701 nt, Artificial Sequence
  derived and/or modified sequence opt2 from hemagglutinin__InfluenzaA__AHL97997
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagauccgcggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103096 - RNA, 1701 nt, Artificial Sequence; identical to SEQ ID NO: 101506
  derived and/or modified sequence opt2 from hemagglutinin__InfluenzaA__AHL98009

SEQ ID NO: 103097 - RNA, 1701 nt, Artificial Sequence
  derived and/or modified sequence opt2 from hemagglutinin__InfluenzaA__AHL98021
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcaagaucugcgacuccccccaccagauccucgacggcgagaacugcacccucauggacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103098 - RNA, 1701 nt, Artificial Sequence; identical to SEQ ID NO: 101380
  derived and/or modified sequence opt2 from hemagglutinin__InfluenzaA__AHL98033

SEQ ID NO: 103099 - RNA, 1701 nt, Artificial Sequence; identical to SEQ ID NO: 102977
  derived and/or modified sequence opt2 from hemagglutinin__InfluenzaA__AHL98045

SEQ ID NO: 103100 - RNA, 1701 nt, Artificial Sequence; identical to SEQ ID NO: 102977
  derived and/or modified sequence opt2 from hemagglutinin__InfluenzaA__AHL98057

SEQ ID NO: 103101 - RNA, 1701 nt, Artificial Sequence; identical to SEQ ID NO: 102977
  derived and/or modified sequence opt2 from hemagglutinin__InfluenzaA__AHL98069

SEQ ID NO: 103102 - RNA, 1701 nt, Artificial Sequence
  derived and/or modified sequence opt2 from hemagglutinin__InfluenzaA__AHL98081
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccacccagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucgucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103103 - RNA, 1701 nt, Artificial Sequence; identical to SEQ ID NO: 101370
  derived and/or modified sequence opt2 from hemagglutinin__InfluenzaA__AHL98093

SEQ ID NO: 103104 - RNA, 1701 nt, Artificial Sequence
  derived and/or modified sequence opt2 from hemagglutinin__InfluenzaA__AHL98105
augaaggccauccucgucgucaugcucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccggcuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaucuccuacaucaacgacaagggcaaggagguccucguccucuggggcauccaccaccccuccaccaccgccgaccagcagucccucuaccagaacgccgacaccuacgucuucgucggcgccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 103105 - RNA, 1701 nt, Artificial Sequence; identical to SEQ ID NO: 101370
  derived and/or modified sequence opt2 from hemagglutinin__InfluenzaA__AHL98116

SEQ ID NO: 103106 - RNA, 1701 nt, Artificial Sequence; identical to SEQ ID NO: 101380
  derived and/or modified sequence opt2 from hemagglutinin__InfluenzaA__AHL98128

SEQ ID NO: 103107 - RNA, 1701 nt, Artificial Sequence; identical to SEQ ID NO: 101370
  derived and/or modified sequence opt2 from hemagglutinin__InfluenzaA__AHL98140

SEQ ID NO: 103108 - RNA, 1701 nt, Artificial Sequence; identical to SEQ ID NO: 101370
  derived and/or modified sequence opt2 from hemagglutinin__InfluenzaA__AHL98152

SEQ ID NO: 103109 - RNA, 1701 nt, Artificial Sequence; identical to SEQ ID NO: 101380
  derived and/or modified sequence opt2 from hemagglutinin__InfluenzaA__AHL98164

SEQ ID NO: 103110 - RNA, 1701 nt, Artificial Sequence; identical to SEQ ID NO: 101380
  derived and/or modified sequence opt2 from hemagglutinin__InfluenzaA__AHL98176

SEQ ID NO: 103111 - RNA, 1701 nt, Artificial Sequence; identical to SEQ ID NO: 101370
  derived and/or modified sequence opt2 from hemagglutinin__InfluenzaA__AHL98188

SEQ ID NO: 103112 - RNA, 1701 nt, Artificial Sequence; identical to SEQ ID NO: 101535
  derived and/or modified sequence opt2 from hemagglutinin__InfluenzaA__AHL98200

SEQ ID NO: 103113 - RNA, 1701 nt, Artificial Sequence; identical to SEQ ID NO: 101370
  derived and/or modified sequence opt2 from hemagglutinin__InfluenzaA__AHL98212

SEQ ID NO: 103114 - RNA, 1701 nt, Artificial Sequence; identical to SEQ ID NO: 101370
  derived and/or modified sequence opt2 from hemagglutinin__InfluenzaA__AHL98224

SEQ ID NO: 103115 - RNA, 1701 nt, Artificial Sequence; identical to SEQ ID NO: 101506
  derived and/or modified sequence opt2 from hemagglutinin__InfluenzaA__AHL98236

SEQ ID NO: 103116 - RNA, 1701 nt, Artificial Sequence; identical to SEQ ID NO: 101380
  derived and/or modified sequence opt2 from hemagglutinin__InfluenzaA__AHL98248

SEQ ID NO: 103117 - RNA, 1701 nt, Artificial Sequence; identical to SEQ ID NO: 101370
  derived and/or modified sequence opt2 from hemagglutinin__InfluenzaA__AHL98260

SEQ ID NO: 103118 - RNA, 1701 nt, Artificial Sequence; identical to SEQ ID NO: 101380
  derived and/or modified sequence opt2 from hemagglutinin__InfluenzaA__AHL98272

SEQ ID NO: 103119 - RNA, 1701 nt, Artificial Sequence; identical to SEQ ID NO: 102976
  derived and/or modified sequence opt2 from hemagglutinin__InfluenzaA__AHL98284

SEQ ID NO: 103120 - RNA, 1701 nt, Artificial Sequence
  derived and/or modified sequence opt2 from hemagglutinin__InfluenzaA__AHL98295
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103121 - RNA, 1701 nt, Artificial Sequence; identical to SEQ ID NO: 103018
  derived and/or modified sequence opt2 from hemagglutinin__InfluenzaA__AHL98307

SEQ ID NO: 103122 - RNA, 1701 nt, Artificial Sequence; identical to SEQ ID NO: 101380
  derived and/or modified sequence opt2 from hemagglutinin__InfluenzaA__AHL98319

SEQ ID NO: 103123 - RNA, 1701 nt, Artificial Sequence; identical to SEQ ID NO: 101380
  derived and/or modified sequence opt2 from hemagglutinin__InfluenzaA__AHL98331

SEQ ID NO: 103124 - RNA, 1701 nt, Artificial Sequence; identical to SEQ ID NO: 101506
  derived and/or modified sequence opt2 from hemagglutinin__InfluenzaA__AHL98343

SEQ ID NO: 103125 - RNA, 1701 nt, Artificial Sequence; identical to SEQ ID NO: 103018
  derived and/or modified sequence opt2 from hemagglutinin__InfluenzaA__AHL98354

SEQ ID NO: 103126 - RNA, 1701 nt, Artificial Sequence; identical to SEQ ID NO: 101370
  derived and/or modified sequence opt2 from hemagglutinin__InfluenzaA__AHL98366

SEQ ID NO: 103127 - RNA, 1701 nt, Artificial Sequence; identical to SEQ ID NO: 101370
  derived and/or modified sequence opt2 from hemagglutinin__InfluenzaA__AHL98378

SEQ ID NO: 103128 - RNA, 1701 nt, Artificial Sequence; identical to SEQ ID NO: 101370
  derived and/or modified sequence opt2 from hemagglutinin__InfluenzaA__AHL98390

SEQ ID NO: 103129 - RNA, 1701 nt, Artificial Sequence; identical to SEQ ID NO: 101370
  derived and/or modified sequence opt2 from hemagglutinin__InfluenzaA__AHL98402

SEQ ID NO: 103130 - RNA, 1701 nt, Artificial Sequence; identical to SEQ ID NO: 101380
  derived and/or modified sequence opt2 from hemagglutinin__InfluenzaA__AHL98414

SEQ ID NO: 103131 - RNA, 1701 nt, Artificial Sequence
  derived and/or modified sequence opt2 from hemagglutinin__InfluenzaA__AHL98426
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccaggucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103132 - RNA, 1701 nt, Artificial Sequence; identical to SEQ ID NO: 101552
  derived and/or modified sequence opt2 from hemagglutinin__InfluenzaA__AHL98438

SEQ ID NO: 103133 - RNA, 1701 nt, Artificial Sequence; identical to SEQ ID NO: 101552
  derived and/or modified sequence opt2 from hemagglutinin__InfluenzaA__AHL98449

SEQ ID NO: 103134 - RNA, 1701 nt, Artificial Sequence
  derived and/or modified sequence opt2 from hemagglutinin__InfluenzaA__AHL98471
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagaaguucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcuccgcgaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucaucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103135 - RNA, 1701 nt, Artificial Sequence; identical to SEQ ID NO: 101506
  derived and/or modified sequence opt2 from hemagglutinin__InfluenzaA__AHL98482

SEQ ID NO: 103136 - RNA, 1701 nt, Artificial Sequence; identical to SEQ ID NO: 101347
  derived and/or modified sequence opt2 from hemagglutinin__InfluenzaA__AHL98494

SEQ ID NO: 103137 - RNA, 1701 nt, Artificial Sequence; identical to SEQ ID NO: 101506
  derived and/or modified sequence opt2 from hemagglutinin__InfluenzaA__AHL98506

SEQ ID NO: 103138 - RNA, 1701 nt, Artificial Sequence; identical to SEQ ID NO: 101506
  derived and/or modified sequence opt2 from hemagglutinin__InfluenzaA__AHL98518

SEQ ID NO: 103139 - RNA, 1701 nt, Artificial Sequence; identical to SEQ ID NO: 101347
  derived and/or modified sequence opt2 from hemagglutinin__InfluenzaA__AHL98530

SEQ ID NO: 103140 - RNA, 1701 nt, Artificial Sequence; identical to SEQ ID NO: 101506
  derived and/or modified sequence opt2 from hemagglutinin__InfluenzaA__AHL98542

SEQ ID NO: 103141 - RNA, 1701 nt, Artificial Sequence; identical to SEQ ID NO: 101506
  derived and/or modified sequence opt2 from hemagglutinin__InfluenzaA__AHL98554

SEQ ID NO: 103142 - RNA, 1701 nt, Artificial Sequence; identical to SEQ ID NO: 101380
  derived and/or modified sequence opt2 from hemagglutinin__InfluenzaA__AHL98566

SEQ ID NO: 103143 - RNA, 1701 nt, Artificial Sequence; identical to SEQ ID NO: 101380
  derived and/or modified sequence opt2 from hemagglutinin__InfluenzaA__AHL98578

SEQ ID NO: 103144 - RNA, 1701 nt, Artificial Sequence; identical to SEQ ID NO: 101506
  derived and/or modified sequence opt2 from hemagglutinin__InfluenzaA__AHL98590

SEQ ID NO: 103145 - RNA, 1701 nt, Artificial Sequence; identical to SEQ ID NO: 101370
  derived and/or modified sequence opt2 from hemagglutinin__InfluenzaA__AHL98602

SEQ ID NO: 103146 - RNA, 1701 nt, Artificial Sequence; identical to SEQ ID NO: 101347
  derived and/or modified sequence opt2 from hemagglutinin__InfluenzaA__AHL98614

SEQ ID NO: 103147 - RNA, 1701 nt, Artificial Sequence
  derived and/or modified sequence opt2 from hemagglutinin__InfluenzaA__AHL98626
augaagaccaucaucgcccucuccuacauccucugccucgucuucgcccaggagcuccccggcaacgacgacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagcgcugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103148 - RNA, 1701 nt, Artificial Sequence; identical to SEQ ID NO: 101370
  derived and/or modified sequence opt2 from hemagglutinin__InfluenzaA__AHL98638

SEQ ID NO: 103149 - RNA, 1701 nt, Artificial Sequence; identical to SEQ ID NO: 101380
  derived and/or modified sequence opt2 from hemagglutinin__InfluenzaA__AHL98650

SEQ ID NO: 103150 - RNA, 1701 nt, Artificial Sequence
  derived and/or modified sequence opt2 from hemagglutinin__InfluenzaA__AHL98662
augaagaccaucaucgcccucuccuacauccucugccucgucuucgcccagaagcuccccggcaacgacaacuccaccgccacccucugccucggccaccacgccguccccaacggcaccauggucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103151 - RNA, 1701 nt, Artificial Sequence; identical to SEQ ID NO: 103018
  derived and/or modified sequence opt2 from hemagglutinin__InfluenzaA__AHL98674

SEQ ID NO: 103152 - RNA, 1701 nt, Artificial Sequence; identical to SEQ ID NO: 101370
  derived and/or modified sequence opt2 from hemagglutinin__InfluenzaA__AHL98686

SEQ ID NO: 103153 - RNA, 1701 nt, Artificial Sequence; identical to SEQ ID NO: 101506
  derived and/or modified sequence opt2 from hemagglutinin__InfluenzaA__AHL98699

SEQ ID NO: 103154 - RNA, 1701 nt, Artificial Sequence; identical to SEQ ID NO: 101635
  derived and/or modified sequence opt2 from hemagglutinin__InfluenzaA__AHL98711

SEQ ID NO: 103155 - RNA, 1701 nt, Artificial Sequence; identical to SEQ ID NO: 101979
  derived and/or modified sequence opt2 from hemagglutinin__InfluenzaA__AHL98722

SEQ ID NO: 103156 - RNA, 1701 nt, Artificial Sequence; identical to SEQ ID NO: 101380
  derived and/or modified sequence opt2 from hemagglutinin__InfluenzaA__AHL98734

SEQ ID NO: 103157 - RNA, 1701 nt, Artificial Sequence; identical to SEQ ID NO: 101506
  derived and/or modified sequence opt2 from hemagglutinin__InfluenzaA__AHL98746

SEQ ID NO: 103158 - RNA, 1701 nt, Artificial Sequence; identical to SEQ ID NO: 101380
  derived and/or modified sequence opt2 from hemagglutinin__InfluenzaA__AHL98758

SEQ ID NO: 103159 - RNA, 1701 nt, Artificial Sequence; identical to SEQ ID NO: 101370
  derived and/or modified sequence opt2 from hemagglutinin__InfluenzaA__AHL98770

SEQ ID NO: 103160 - RNA, 1701 nt, Artificial Sequence; identical to SEQ ID NO: 101509
  derived and/or modified sequence opt2 from hemagglutinin__InfluenzaA__AHL98782

SEQ ID NO: 103161 - RNA, 1701 nt, Artificial Sequence
  derived and/or modified sequence opt2 from hemagglutinin__InfluenzaA__AHL98794
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugccgcuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103162 - RNA, 1701 nt, Artificial Sequence
  derived and/or modified sequence opt2 from hemagglutinin__InfluenzaA__AHL98806
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccagaccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103163 - RNA, 1701 nt, Artificial Sequence; identical to SEQ ID NO: 101370
  derived and/or modified sequence opt2 from hemagglutinin__InfluenzaA__AHL98818

SEQ ID NO: 103164 - RNA, 1701 nt, Artificial Sequence; identical to SEQ ID NO: 101380
  derived and/or modified sequence opt2 from hemagglutinin__InfluenzaA__AHL98830

SEQ ID NO: 103165 - RNA, 1701 nt, Artificial Sequence; identical to SEQ ID NO: 101370
  derived and/or modified sequence opt2 from hemagglutinin__InfluenzaA__AHL98842

SEQ ID NO: 103166 - RNA, 1701 nt, Artificial Sequence; identical to SEQ ID NO: 101370
  derived and/or modified sequence opt2 from hemagglutinin__InfluenzaA__AHL98854

SEQ ID NO: 103167 - RNA, 1701 nt, Artificial Sequence
  derived and/or modified sequence opt2 from hemagglutinin__InfluenzaA__AHL98878
augaagaccaucaucgcccucuccuacauccucugccucgucuucacccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103168 - RNA, 1701 nt, Artificial Sequence
  derived and/or modified sequence opt2 from hemagglutinin__InfluenzaA__AHL98890
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugccuccuccucugcgucgcccuccucggcuucaucaugugggccugccagaagggcaacauccgcugcaacaucugcaucuga

SEQ ID NO: 103169 - RNA, 1701 nt, Artificial Sequence
  derived and/or modified sequence opt2 from hemagglutinin__InfluenzaA__AHL98902
augaagaccaucaucgcccucuccuacauccucugccucgucuucgcccagaagcuccccggcaacgacaacuccaccgccacccucugccucggccaccacgccguccccaacggcaccgucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103170 - RNA, 1701 nt, Artificial Sequence; identical to SEQ ID NO: 101380
  derived and/or modified sequence opt2 from hemagglutinin__InfluenzaA__AHL98913

SEQ ID NO: 103171 - RNA, 1701 nt, Artificial Sequence; identical to SEQ ID NO: 101370
  derived and/or modified sequence opt2 from hemagglutinin__InfluenzaA__AHL98925

SEQ ID NO: 103172 - RNA, 1701 nt, Artificial Sequence; identical to SEQ ID NO: 101509
  derived and/or modified sequence opt2 from hemagglutinin__InfluenzaA__AHL98937

SEQ ID NO: 103173 - RNA, 1701 nt, Artificial Sequence; identical to SEQ ID NO: 101506
  derived and/or modified sequence opt2 from hemagglutinin__InfluenzaA__AHL98961

SEQ ID NO: 103174 - RNA, 1701 nt, Artificial Sequence
  derived and/or modified sequence opt2 from hemagglutinin__InfluenzaA__AHL98973
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucguccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccauguccugcuuccuccucugcgucgcccuccucggcuucaucaugugggccugccagaagggcaacauccgcugcaacaucugcaucuga

SEQ ID NO: 103175 - RNA, 1701 nt, Artificial Sequence
  derived and/or modified sequence opt2 from hemagglutinin__InfluenzaA__AHL98985
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcaccaucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103176 - RNA, 1701 nt, Artificial Sequence; identical to SEQ ID NO: 101506
  derived and/or modified sequence opt2 from hemagglutinin__InfluenzaA__AHL98997

SEQ ID NO: 103177 - RNA, 1701 nt, Artificial Sequence; identical to SEQ ID NO: 101370
  derived and/or modified sequence opt2 from hemagglutinin__InfluenzaA__AHL99009

SEQ ID NO: 103178 - RNA, 1701 nt, Artificial Sequence; identical to SEQ ID NO: 101380
  derived and/or modified sequence opt2 from hemagglutinin__InfluenzaA__AHL99021

SEQ ID NO: 103179 - RNA, 1701 nt, Artificial Sequence
  derived and/or modified sequence opt2 from hemagglutinin__InfluenzaA__AHL99045
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggccccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103180 - RNA, 1701 nt, Artificial Sequence
  derived and/or modified sequence opt2 from hemagglutinin__InfluenzaA__AHL99057
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagaucaucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103181 - RNA, 1701 nt, Artificial Sequence
  derived and/or modified sequence opt2 from hemagglutinin__InfluenzaA__AHL99069
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacacccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103182 - RNA, 1701 nt, Artificial Sequence
  derived and/or modified sequence opt2 from hemagglutinin__InfluenzaA__AHL99081
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcagggcacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103183 - RNA, 1701 nt, Artificial Sequence
  derived and/or modified sequence opt2 from hemagglutinin__InfluenzaA__AHL99093
augaagaccaucaucgcccucuccuacauccucugccucaucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacaucaagugcaacaucugcaucuga

SEQ ID NO: 103184 - RNA, 1701 nt, Artificial Sequence; identical to SEQ ID NO: 101370
  derived and/or modified sequence opt2 from hemagglutinin__InfluenzaA__AHL99117

SEQ ID NO: 103185 - RNA, 1701 nt, Artificial Sequence
  derived and/or modified sequence opt2 from hemagglutinin__InfluenzaA__AHL99129
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggacaucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaucugggccugccagaagggcaacauccgcugcaacaucugcaucuga

SEQ ID NO: 103186 - RNA, 1701 nt, Artificial Sequence
  derived and/or modified sequence opt2 from hemagglutinin__InfluenzaA__AHL99141
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucgacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103187 - RNA, 1701 nt, Artificial Sequence
  derived and/or modified sequence opt2 from hemagglutinin__InfluenzaA__AHL99153
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucacccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103188 - RNA, 1701 nt, Artificial Sequence; identical to SEQ ID NO: 101509
  derived and/or modified sequence opt2 from hemagglutinin__InfluenzaA__AHL99165

SEQ ID NO: 103189 - RNA, 1701 nt, Artificial Sequence; identical to SEQ ID NO: 101994
  derived and/or modified sequence opt2 from hemagglutinin__InfluenzaA__AHL99177

SEQ ID NO: 103190 - RNA, 1701 nt, Artificial Sequence; identical to SEQ ID NO: 101370
  derived and/or modified sequence opt2 from hemagglutinin__InfluenzaA__AHL99189

SEQ ID NO: 103191 - RNA, 1701 nt, Artificial Sequence; identical to SEQ ID NO: 101506
  derived and/or modified sequence opt2 from hemagglutinin__InfluenzaA__AHL99225

SEQ ID NO: 103192 - RNA, 1701 nt, Artificial Sequence; identical to SEQ ID NO: 101979
  derived and/or modified sequence opt2 from hemagglutinin__InfluenzaA__AHL99237

SEQ ID NO: 103193 - RNA, 1701 nt, Artificial Sequence; identical to SEQ ID NO: 101380
  derived and/or modified sequence opt2 from hemagglutinin__InfluenzaA__AHL99249

SEQ ID NO: 103194 - RNA, 1701 nt, Artificial Sequence; identical to SEQ ID NO: 101370
  derived and/or modified sequence opt2 from hemagglutinin__InfluenzaA__AHL99261

SEQ ID NO: 103195 - RNA, 1701 nt, Artificial Sequence; identical to SEQ ID NO: 101509
  derived and/or modified sequence opt2 from hemagglutinin__InfluenzaA__AHL99273

SEQ ID NO: 103196 - RNA, 1701 nt, Artificial Sequence
  derived and/or modified sequence opt2 from hemagglutinin__InfluenzaA__AHL99285
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103197 - RNA, 1701 nt, Artificial Sequence; identical to SEQ ID NO: 101535
  derived and/or modified sequence opt2 from hemagglutinin__InfluenzaA__AHL99297

SEQ ID NO: 103198 - RNA, 1701 nt, Artificial Sequence; identical to SEQ ID NO: 101380
  derived and/or modified sequence opt2 from hemagglutinin__InfluenzaA__AHL99309

SEQ ID NO: 103199 - RNA, 1701 nt, Artificial Sequence
  derived and/or modified sequence opt2 from hemagglutinin__InfluenzaA__AHL99321
augaagaccaucaucgcccucuccuacauccucugccucgucuucacccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103200 - RNA, 1701 nt, Artificial Sequence
  derived and/or modified sequence opt2 from hemagglutinin__InfluenzaA__AHL99333
augaagaccaucaucgcccucuccuacauccucugccucgucuucgcccaggagcuccccggcaacgacgacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103201 - RNA, 1701 nt, Artificial Sequence
  derived and/or modified sequence opt2 from hemagglutinin__InfluenzaA__AHL99356
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccuccaaguacuccaagaaguucaagcccgagaucgccauccgccccaagguccgcgaccaggagggccgcaugaacuacuacuggacccucaucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103202 - RNA, 1701 nt, Artificial Sequence; identical to SEQ ID NO: 101395
  derived and/or modified sequence opt2 from hemagglutinin__InfluenzaA__AHL99367

SEQ ID NO: 103203 - RNA, 1701 nt, Artificial Sequence
  derived and/or modified sequence opt2 from hemagglutinin__InfluenzaA__AHL99379
augaaggccauccucgucgucaugcucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccggcuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaucuccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 103204 - RNA, 1701 nt, Artificial Sequence; identical to SEQ ID NO: 103196
  derived and/or modified sequence opt2 from hemagglutinin__InfluenzaA__AHL99390

SEQ ID NO: 103205 - RNA, 1701 nt, Artificial Sequence; identical to SEQ ID NO: 101370
  derived and/or modified sequence opt2 from hemagglutinin__InfluenzaA__AHL99402

SEQ ID NO: 103206 - RNA, 1701 nt, Artificial Sequence
  derived and/or modified sequence opt2 from hemagglutinin__InfluenzaA__AHL99426
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaugaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103207 - RNA, 1701 nt, Artificial Sequence
  derived and/or modified sequence opt2 from hemagglutinin__InfluenzaA__AHL99438
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103208 - RNA, 1701 nt, Artificial Sequence; identical to SEQ ID NO: 101506
  derived and/or modified sequence opt2 from hemagglutinin__InfluenzaA__AHL99450

SEQ ID NO: 103209 - RNA, 1701 nt, Artificial Sequence; identical to SEQ ID NO: 101979
  derived and/or modified sequence opt2 from hemagglutinin__InfluenzaA__AHL99462

SEQ ID NO: 103210 - RNA, 1701 nt, Artificial Sequence; identical to SEQ ID NO: 101509
  derived and/or modified sequence opt2 from hemagglutinin__InfluenzaA__AHL99474

SEQ ID NO: 103211 - RNA, 1701 nt, Artificial Sequence; identical to SEQ ID NO: 101535
  derived and/or modified sequence opt2 from hemagglutinin__InfluenzaA__AHL99486

SEQ ID NO: 103212 - RNA, 1701 nt, Artificial Sequence; identical to SEQ ID NO: 101506
  derived and/or modified sequence opt2 from hemagglutinin__InfluenzaA__AHL99498

SEQ ID NO: 103213 - RNA, 1701 nt, Artificial Sequence; identical to SEQ ID NO: 101370
  derived and/or modified sequence opt2 from hemagglutinin__InfluenzaA__AHL99510

SEQ ID NO: 103214 - RNA, 1701 nt, Artificial Sequence; identical to SEQ ID NO: 101370
  derived and/or modified sequence opt2 from hemagglutinin__InfluenzaA__AHL99522

SEQ ID NO: 103215 - RNA, 1701 nt, Artificial Sequence; identical to SEQ ID NO: 101395
  derived and/or modified sequence opt2 from hemagglutinin__InfluenzaA__AHL99534

SEQ ID NO: 103216 - RNA, 1701 nt, Artificial Sequence; identical to SEQ ID NO: 101370
  derived and/or modified sequence opt2 from hemagglutinin__InfluenzaA__AHL99546

SEQ ID NO: 103217 - RNA, 1701 nt, Artificial Sequence; identical to SEQ ID NO: 101370
  derived and/or modified sequence opt2 from hemagglutinin__InfluenzaA__AHL99558

SEQ ID NO: 103218 - RNA, 1701 nt, Artificial Sequence
  derived and/or modified sequence opt2 from hemagglutinin__InfluenzaA__AHL99570
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccuccugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacaucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103219 - RNA, 1701 nt, Artificial Sequence; identical to SEQ ID NO: 101370
  derived and/or modified sequence opt2 from hemagglutinin__InfluenzaA__AHL99582

SEQ ID NO: 103220 - RNA, 1701 nt, Artificial Sequence
  derived and/or modified sequence opt2 from hemagglutinin__InfluenzaA__AHL99594
augaaggccauccucgucgucaugcucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccggcuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccgcgccggcgccaagggcuucuacaagaaccucaucuggcucgucaagaagggcaacuccuaccccaagcucuccaucuccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 103221 - RNA, 1701 nt, Artificial Sequence; identical to SEQ ID NO: 101979
  derived and/or modified sequence opt2 from hemagglutinin__InfluenzaA__AHL99605

SEQ ID NO: 103222 - RNA, 1701 nt, Artificial Sequence; identical to SEQ ID NO: 101509
  derived and/or modified sequence opt2 from hemagglutinin__InfluenzaA__AHL99617

SEQ ID NO: 103223 - RNA, 1701 nt, Artificial Sequence; identical to SEQ ID NO: 101370
  derived and/or modified sequence opt2 from hemagglutinin__InfluenzaA__AHL99629

SEQ ID NO: 103224 - RNA, 1701 nt, Artificial Sequence
  derived and/or modified sequence opt2 from hemagglutinin__InfluenzaA__AHL99641
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucguccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccauguccugcuuccuccucugcgucgcccuccucggcuucaucaugugggccugccagaagggcaacauccgcugcaacaucugcaucuga

SEQ ID NO: 103225 - RNA, 1701 nt, Artificial Sequence
  derived and/or modified sequence opt2 from hemagglutinin__InfluenzaA__AHL99665
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacaucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103226 - RNA, 1701 nt, Artificial Sequence; identical to SEQ ID NO: 101370
  derived and/or modified sequence opt2 from hemagglutinin__InfluenzaA__AHL99677

SEQ ID NO: 103227 - RNA, 1701 nt, Artificial Sequence; identical to SEQ ID NO: 101370
  derived and/or modified sequence opt2 from hemagglutinin__InfluenzaA__AHL99689

SEQ ID NO: 103228 - RNA, 1701 nt, Artificial Sequence
  derived and/or modified sequence opt2 from hemagglutinin__InfluenzaA__AHL99701
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucacccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103229 - RNA, 1701 nt, Artificial Sequence
  derived and/or modified sequence opt2 from hemagglutinin__InfluenzaA__AHL99713
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacaccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucaccugcuuccuccucugcgucgcccuccucggcuucaucaugugggccugccagaagggcaacauccgcugcaacaucugcaucuga

SEQ ID NO: 103230 - RNA, 1701 nt, Artificial Sequence; identical to SEQ ID NO: 101370
  derived and/or modified sequence opt2 from hemagglutinin__InfluenzaA__AHL99725

SEQ ID NO: 103231 - RNA, 1701 nt, Artificial Sequence; identical to SEQ ID NO: 101572
  derived and/or modified sequence opt2 from hemagglutinin__InfluenzaA__AHL99737

SEQ ID NO: 103232 - RNA, 1701 nt, Artificial Sequence; identical to SEQ ID NO: 101370
  derived and/or modified sequence opt2 from hemagglutinin__InfluenzaA__AHL99748

SEQ ID NO: 103233 - RNA, 1701 nt, Artificial Sequence; identical to SEQ ID NO: 101370
  derived and/or modified sequence opt2 from hemagglutinin__InfluenzaA__AHL99760

SEQ ID NO: 103234 - RNA, 1701 nt, Artificial Sequence; identical to SEQ ID NO: 101380
  derived and/or modified sequence opt2 from hemagglutinin__InfluenzaA__AHL99772

SEQ ID NO: 103235 - RNA, 1701 nt, Artificial Sequence; identical to SEQ ID NO: 101395
  derived and/or modified sequence opt2 from hemagglutinin__InfluenzaA__AHL99784

SEQ ID NO: 103236 - RNA, 1701 nt, Artificial Sequence; identical to SEQ ID NO: 101535
  derived and/or modified sequence opt2 from hemagglutinin__InfluenzaA__AHL99796

SEQ ID NO: 103237 - RNA, 1701 nt, Artificial Sequence; identical to SEQ ID NO: 101370
  derived and/or modified sequence opt2 from hemagglutinin__InfluenzaA__AHL99808

SEQ ID NO: 103238 - RNA, 1701 nt, Artificial Sequence
  derived and/or modified sequence opt2 from hemagglutinin__InfluenzaA__AHL99820
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgacggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 103239 - RNA, 1701 nt, Artificial Sequence; identical to SEQ ID NO: 101370
  derived and/or modified sequence opt2 from hemagglutinin__InfluenzaA__AHL99832

SEQ ID NO: 103240 - RNA, 1701 nt, Artificial Sequence; identical to SEQ ID NO: 101395
  derived and/or modified sequence opt2 from hemagglutinin__InfluenzaA__AHL99844

SEQ ID NO: 103241 - RNA, 1701 nt, Artificial Sequence; identical to SEQ ID NO: 101347
  derived and/or modified sequence opt2 from hemagglutinin__InfluenzaA__AHL99856

SEQ ID NO: 103242 - RNA, 1701 nt, Artificial Sequence
  derived and/or modified sequence opt2 from hemagglutinin__InfluenzaA__AHL99868
augaagaccaucaucgcccucuccuacauccucugccucgucuucgcccaggagcuccccggcaacgacgacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagaagucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103243 - RNA, 1701 nt, Artificial Sequence; identical to SEQ ID NO: 101509
  derived and/or modified sequence opt2 from hemagglutinin__InfluenzaA__AHL99880

SEQ ID NO: 103244 - RNA, 1701 nt, Artificial Sequence; identical to SEQ ID NO: 101370
  derived and/or modified sequence opt2 from hemagglutinin__InfluenzaA__AHL99892

SEQ ID NO: 103245 - RNA, 1701 nt, Artificial Sequence; identical to SEQ ID NO: 101506
  derived and/or modified sequence opt2 from hemagglutinin__InfluenzaA__AHL99904

SEQ ID NO: 103246 - RNA, 1701 nt, Artificial Sequence
  derived and/or modified sequence opt2 from hemagglutinin__InfluenzaA__AHL99916
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagaugcgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103247 - RNA, 1701 nt, Artificial Sequence; identical to SEQ ID NO: 101395
  derived and/or modified sequence opt2 from hemagglutinin__InfluenzaA__AHL99928

SEQ ID NO: 103248 - RNA, 1701 nt, Artificial Sequence
  derived and/or modified sequence opt2 from hemagglutinin__InfluenzaA__AHL99940
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccggcgucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103249 - RNA, 1701 nt, Artificial Sequence; identical to SEQ ID NO: 101370
  derived and/or modified sequence opt2 from hemagglutinin__InfluenzaA__AHL99952

SEQ ID NO: 103250 - RNA, 1701 nt, Artificial Sequence; identical to SEQ ID NO: 101395
  derived and/or modified sequence opt2 from hemagglutinin__InfluenzaA__AHL99964

SEQ ID NO: 103251 - RNA, 1701 nt, Artificial Sequence; identical to SEQ ID NO: 101395
  derived and/or modified sequence opt2 from hemagglutinin__InfluenzaA__AHL99976

SEQ ID NO: 103252 - RNA, 1701 nt, Artificial Sequence; identical to SEQ ID NO: 101395
  derived and/or modified sequence opt2 from hemagglutinin__InfluenzaA__AHL99988

SEQ ID NO: 103253 - RNA, 1701 nt, Artificial Sequence; identical to SEQ ID NO: 101370
  derived and/or modified sequence opt2 from hemagglutinin__InfluenzaA__AHM00001

SEQ ID NO: 103254 - RNA, 1701 nt, Artificial Sequence; identical to SEQ ID NO: 101370
  derived and/or modified sequence opt2 from hemagglutinin__InfluenzaA__AHM00013

SEQ ID NO: 103255 - RNA, 1701 nt, Artificial Sequence; identical to SEQ ID NO: 101380
  derived and/or modified sequence opt2 from hemagglutinin__InfluenzaA__AHM00025

SEQ ID NO: 103256 - RNA, 1701 nt, Artificial Sequence; identical to SEQ ID NO: 101395
  derived and/or modified sequence opt2 from hemagglutinin__InfluenzaA__AHM00037

SEQ ID NO: 103257 - RNA, 1701 nt, Artificial Sequence; identical to SEQ ID NO: 101395
  derived and/or modified sequence opt2 from hemagglutinin__InfluenzaA__AHM00061

SEQ ID NO: 103258 - RNA, 1701 nt, Artificial Sequence; identical to SEQ ID NO: 101370
  derived and/or modified sequence opt2 from hemagglutinin__InfluenzaA__AHM00073

SEQ ID NO: 103259 - RNA, 1701 nt, Artificial Sequence; identical to SEQ ID NO: 101370
  derived and/or modified sequence opt2 from hemagglutinin__InfluenzaA__AHM00085

SEQ ID NO: 103260 - RNA, 1701 nt, Artificial Sequence
  derived and/or modified sequence opt2 from hemagglutinin__InfluenzaA__AHM00097
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaacuccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacaccaccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaugugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103261 - RNA, 1701 nt, Artificial Sequence; identical to SEQ ID NO: 101395
  derived and/or modified sequence opt2 from hemagglutinin__InfluenzaA__AHM00108

SEQ ID NO: 103262 - RNA, 1701 nt, Artificial Sequence; identical to SEQ ID NO: 101395
  derived and/or modified sequence opt2 from hemagglutinin__InfluenzaA__AHM00120

SEQ ID NO: 103263 - RNA, 1701 nt, Artificial Sequence
  derived and/or modified sequence opt2 from hemagglutinin__InfluenzaA__AHM00132
augaagaccaucaucgcccucuccuacauccucugccucgucuucgcccaggagcuccccggcaacgacgacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucucccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103264 - RNA, 1701 nt, Artificial Sequence; identical to SEQ ID NO: 101370
  derived and/or modified sequence opt2 from hemagglutinin__InfluenzaA__AHM00144

SEQ ID NO: 103265 - RNA, 1701 nt, Artificial Sequence; identical to SEQ ID NO: 101395
  derived and/or modified sequence opt2 from hemagglutinin__InfluenzaA__AHM00156

SEQ ID NO: 103266 - RNA, 1701 nt, Artificial Sequence; identical to SEQ ID NO: 101370
  derived and/or modified sequence opt2 from hemagglutinin__InfluenzaA__AHM00168

SEQ ID NO: 103267 - RNA, 1701 nt, Artificial Sequence
  derived and/or modified sequence opt2 from hemagglutinin__InfluenzaA__AHM00180
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacaacccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103268 - RNA, 1701 nt, Artificial Sequence; identical to SEQ ID NO: 101347
  derived and/or modified sequence opt2 from hemagglutinin__InfluenzaA__AHM00192

SEQ ID NO: 103269 - RNA, 1701 nt, Artificial Sequence; identical to SEQ ID NO: 101395
  derived and/or modified sequence opt2 from hemagglutinin__InfluenzaA__AHM00204

SEQ ID NO: 103270 - RNA, 1701 nt, Artificial Sequence; identical to SEQ ID NO: 101395
  derived and/or modified sequence opt2 from hemagglutinin__InfluenzaA__AHM00216

SEQ ID NO: 103271 - RNA, 1701 nt, Artificial Sequence; identical to SEQ ID NO: 101370
  derived and/or modified sequence opt2 from hemagglutinin__InfluenzaA__AHM00228

SEQ ID NO: 103272 - RNA, 1701 nt, Artificial Sequence; identical to SEQ ID NO: 101370
  derived and/or modified sequence opt2 from hemagglutinin__InfluenzaA__AHM00240

SEQ ID NO: 103273 - RNA, 1701 nt, Artificial Sequence; identical to SEQ ID NO: 101370
  derived and/or modified sequence opt2 from hemagglutinin__InfluenzaA__AHM00252

SEQ ID NO: 103274 - RNA, 1701 nt, Artificial Sequence; identical to SEQ ID NO: 101370
  derived and/or modified sequence opt2 from hemagglutinin__InfluenzaA__AHM00264

SEQ ID NO: 103275 - RNA, 1701 nt, Artificial Sequence; identical to SEQ ID NO: 101347
  derived and/or modified sequence opt2 from hemagglutinin__InfluenzaA__AHM00276

SEQ ID NO: 103276 - RNA, 1701 nt, Artificial Sequence; identical to SEQ ID NO: 101370
  derived and/or modified sequence opt2 from hemagglutinin__InfluenzaA__AHM00288

SEQ ID NO: 103277 - RNA, 1701 nt, Artificial Sequence; identical to SEQ ID NO: 101370
  derived and/or modified sequence opt2 from hemagglutinin__InfluenzaA__AHM00300

SEQ ID NO: 103278 - RNA, 1701 nt, Artificial Sequence; identical to SEQ ID NO: 101395
  derived and/or modified sequence opt2 from hemagglutinin__InfluenzaA__AHM00312

SEQ ID NO: 103279 - RNA, 1701 nt, Artificial Sequence; identical to SEQ ID NO: 101347
  derived and/or modified sequence opt2 from hemagglutinin__InfluenzaA__AHM00324

SEQ ID NO: 103280 - RNA, 1701 nt, Artificial Sequence; identical to SEQ ID NO: 101347
  derived and/or modified sequence opt2 from hemagglutinin__InfluenzaA__AHM00336

SEQ ID NO: 103281 - RNA, 1701 nt, Artificial Sequence; identical to SEQ ID NO: 101395
  derived and/or modified sequence opt2 from hemagglutinin__InfluenzaA__AHM00348

SEQ ID NO: 103282 - RNA, 1701 nt, Artificial Sequence
  derived and/or modified sequence opt2 from hemagglutinin__InfluenzaA__AHM00360
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103283 - RNA, 1701 nt, Artificial Sequence; identical to SEQ ID NO: 101395
  derived and/or modified sequence opt2 from hemagglutinin__InfluenzaA__AHM00372

SEQ ID NO: 103284 - RNA, 1701 nt, Artificial Sequence; identical to SEQ ID NO: 101395
  derived and/or modified sequence opt2 from hemagglutinin__InfluenzaA__AHM00395

SEQ ID NO: 103285 - RNA, 1701 nt, Artificial Sequence; identical to SEQ ID NO: 101370
  derived and/or modified sequence opt2 from hemagglutinin__InfluenzaA__AHM00407

SEQ ID NO: 103286 - RNA, 1701 nt, Artificial Sequence; identical to SEQ ID NO: 101370
  derived and/or modified sequence opt2 from hemagglutinin__InfluenzaA__AHM00419

SEQ ID NO: 103287 - RNA, 1701 nt, Artificial Sequence; identical to SEQ ID NO: 101370
  derived and/or modified sequence opt2 from hemagglutinin__InfluenzaA__AHM00443

SEQ ID NO: 103288 - RNA, 1701 nt, Artificial Sequence; identical to SEQ ID NO: 101395
  derived and/or modified sequence opt2 from hemagglutinin__InfluenzaA__AHM00455

SEQ ID NO: 103289 - RNA, 1701 nt, Artificial Sequence; identical to SEQ ID NO: 101395
  derived and/or modified sequence opt2 from hemagglutinin__InfluenzaA__AHM00467

SEQ ID NO: 103290 - RNA, 1701 nt, Artificial Sequence; identical to SEQ ID NO: 101395
  derived and/or modified sequence opt2 from hemagglutinin__InfluenzaA__AHM00479

SEQ ID NO: 103291 - RNA, 1701 nt, Artificial Sequence; identical to SEQ ID NO: 101395
  derived and/or modified sequence opt2 from hemagglutinin__InfluenzaA__AHM00491

SEQ ID NO: 103292 - RNA, 1701 nt, Artificial Sequence; identical to SEQ ID NO: 101370
  derived and/or modified sequence opt2 from hemagglutinin__InfluenzaA__AHM00503

SEQ ID NO: 103293 - RNA, 1701 nt, Artificial Sequence; identical to SEQ ID NO: 101370
  derived and/or modified sequence opt2 from hemagglutinin__InfluenzaA__AHM00515

SEQ ID NO: 103294 - RNA, 1701 nt, Artificial Sequence
  derived and/or modified sequence opt2 from hemagglutinin__InfluenzaA__AHM00527
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacucccccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103295 - RNA, 1701 nt, Artificial Sequence; identical to SEQ ID NO: 101347
  derived and/or modified sequence opt2 from hemagglutinin__InfluenzaA__AHM00539

SEQ ID NO: 103296 - RNA, 1701 nt, Artificial Sequence
  derived and/or modified sequence opt2 from hemagglutinin__InfluenzaA__AHM00543
augaagaccaucaucgcccucuccuacauccucugccucgucuucgcccaggagcuccccggcaacgacgacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcaccauggaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103297 - RNA, 1701 nt, Artificial Sequence; identical to SEQ ID NO: 101370
  derived and/or modified sequence opt2 from hemagglutinin__InfluenzaA__AHM00555

SEQ ID NO: 103298 - RNA, 1701 nt, Artificial Sequence
  derived and/or modified sequence opt2 from hemagglutinin__InfluenzaA__AHM00567
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103299 - RNA, 1701 nt, Artificial Sequence; identical to SEQ ID NO: 101370
  derived and/or modified sequence opt2 from hemagglutinin__InfluenzaA__AHM00579

SEQ ID NO: 103300 - RNA, 1701 nt, Artificial Sequence; identical to SEQ ID NO: 101395
  derived and/or modified sequence opt2 from hemagglutinin__InfluenzaA__AHM00591

SEQ ID NO: 103301 - RNA, 1701 nt, Artificial Sequence; identical to SEQ ID NO: 101370
  derived and/or modified sequence opt2 from hemagglutinin__InfluenzaA__AHM00603

SEQ ID NO: 103302 - RNA, 1701 nt, Artificial Sequence; identical to SEQ ID NO: 101370
  derived and/or modified sequence opt2 from hemagglutinin__InfluenzaA__AHM00615

SEQ ID NO: 103303 - RNA, 1701 nt, Artificial Sequence
  derived and/or modified sequence opt2 from hemagglutinin__InfluenzaA__AHM00627
augaagaccaccaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103304 - RNA, 1701 nt, Artificial Sequence; identical to SEQ ID NO: 101370
  derived and/or modified sequence opt2 from hemagglutinin__InfluenzaA__AHM00639

SEQ ID NO: 103305 - RNA, 1701 nt, Artificial Sequence; identical to SEQ ID NO: 101347
  derived and/or modified sequence opt2 from hemagglutinin__InfluenzaA__AHM00651

SEQ ID NO: 103306 - RNA, 1701 nt, Artificial Sequence; identical to SEQ ID NO: 101506
  derived and/or modified sequence opt2 from hemagglutinin__InfluenzaA__AHM00663

SEQ ID NO: 103307 - RNA, 1701 nt, Artificial Sequence; identical to SEQ ID NO: 101395
  derived and/or modified sequence opt2 from hemagglutinin__InfluenzaA__AHM00675

SEQ ID NO: 103308 - RNA, 1701 nt, Artificial Sequence; identical to SEQ ID NO: 102457
  derived and/or modified sequence opt2 from hemagglutinin__InfluenzaA__AHM00687

SEQ ID NO: 103309 - RNA, 1701 nt, Artificial Sequence
  derived and/or modified sequence opt2 from hemagglutinin__InfluenzaA__AHM00698
augaagaccaucaucgcccucuccuacauccucugccucgucuucgcccaggagcuccccggcaacgacgacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcacccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103310 - RNA, 1701 nt, Artificial Sequence; identical to SEQ ID NO: 101370
  derived and/or modified sequence opt2 from hemagglutinin__InfluenzaA__AHM00710

SEQ ID NO: 103311 - RNA, 1701 nt, Artificial Sequence; identical to SEQ ID NO: 101370
  derived and/or modified sequence opt2 from hemagglutinin__InfluenzaA__AHM00722

SEQ ID NO: 103312 - RNA, 1701 nt, Artificial Sequence; identical to SEQ ID NO: 101370
  derived and/or modified sequence opt2 from hemagglutinin__InfluenzaA__AHM00734

SEQ ID NO: 103313 - RNA, 1701 nt, Artificial Sequence; identical to SEQ ID NO: 101505
  derived and/or modified sequence opt2 from hemagglutinin__InfluenzaA__AHM00746

SEQ ID NO: 103314 - RNA, 1701 nt, Artificial Sequence; identical to SEQ ID NO: 101370
  derived and/or modified sequence opt2 from hemagglutinin__InfluenzaA__AHM00758

SEQ ID NO: 103315 - RNA, 1701 nt, Artificial Sequence; identical to SEQ ID NO: 101538
  derived and/or modified sequence opt2 from hemagglutinin__InfluenzaA__AHM00770

SEQ ID NO: 103316 - RNA, 1701 nt, Artificial Sequence; identical to SEQ ID NO: 101347
  derived and/or modified sequence opt2 from hemagglutinin__InfluenzaA__AHM00782

SEQ ID NO: 103317 - RNA, 1701 nt, Artificial Sequence
  derived and/or modified sequence opt2 from hemagglutinin__InfluenzaA__AHM00794
augaagaccaucaucgcccucuccuacauccucugccucgucuucacccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103318 - RNA, 1701 nt, Artificial Sequence; identical to SEQ ID NO: 101538
  derived and/or modified sequence opt2 from hemagglutinin__InfluenzaA__AHM00806

SEQ ID NO: 103319 - RNA, 1701 nt, Artificial Sequence
  derived and/or modified sequence opt2 from hemagglutinin__InfluenzaA__AHM00818
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgagaacuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103320 - RNA, 1701 nt, Artificial Sequence; identical to SEQ ID NO: 101395
  derived and/or modified sequence opt2 from hemagglutinin__InfluenzaA__AHM00830

SEQ ID NO: 103321 - RNA, 1701 nt, Artificial Sequence; identical to SEQ ID NO: 101395
  derived and/or modified sequence opt2 from hemagglutinin__InfluenzaA__AHM00842

SEQ ID NO: 103322 - RNA, 1701 nt, Artificial Sequence; identical to SEQ ID NO: 103298
  derived and/or modified sequence opt2 from hemagglutinin__InfluenzaA__AHM00854

SEQ ID NO: 103323 - RNA, 1701 nt, Artificial Sequence; identical to SEQ ID NO: 103298
  derived and/or modified sequence opt2 from hemagglutinin__InfluenzaA__AHM00866

SEQ ID NO: 103324 - RNA, 1701 nt, Artificial Sequence; identical to SEQ ID NO: 101370
  derived and/or modified sequence opt2 from hemagglutinin__InfluenzaA__AHM00878

SEQ ID NO: 103325 - RNA, 1701 nt, Artificial Sequence; identical to SEQ ID NO: 101347
  derived and/or modified sequence opt2 from hemagglutinin__InfluenzaA__AHM00890

SEQ ID NO: 103326 - RNA, 1701 nt, Artificial Sequence; identical to SEQ ID NO: 101380
  derived and/or modified sequence opt2 from hemagglutinin__InfluenzaA__AHM00902

SEQ ID NO: 103327 - RNA, 1701 nt, Artificial Sequence; identical to SEQ ID NO: 101370
  derived and/or modified sequence opt2 from hemagglutinin__InfluenzaA__AHM00914

SEQ ID NO: 103328 - RNA, 1701 nt, Artificial Sequence; identical to SEQ ID NO: 101370
  derived and/or modified sequence opt2 from hemagglutinin__InfluenzaA__AHM00926

SEQ ID NO: 103329 - RNA, 1701 nt, Artificial Sequence; identical to SEQ ID NO: 101347
  derived and/or modified sequence opt2 from hemagglutinin__InfluenzaA__AHM00938

SEQ ID NO: 103330 - RNA, 1701 nt, Artificial Sequence
  derived and/or modified sequence opt2 from hemagglutinin__InfluenzaA__AHM00950
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccauguccugcuuccuccucugcgucgcccuccucggcuucaucaugugggccugccagaagggcaacauccgcugcaacaucugcaucuga

SEQ ID NO: 103331 - RNA, 1701 nt, Artificial Sequence; identical to SEQ ID NO: 101347
  derived and/or modified sequence opt2 from hemagglutinin__InfluenzaA__AHM00962

SEQ ID NO: 103332 - RNA, 1701 nt, Artificial Sequence
  derived and/or modified sequence opt2 from hemagglutinin__InfluenzaA__AHM00974
augaagaccaucaucgcccucuccuacauccucugccucgucuucgcccaggagcuccccggcaacgacgacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggcggcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103333 - RNA, 1683 nt, Artificial Sequence
  derived and/or modified sequence opt2 from hemagglutinin__InfluenzaA__AHM24224
augaacacccagauccucgucuucgcccucaucgccaucauccccaccaacgccgacaagaucugccucggccaccacgccgucuccaacggcaccaaggucaacacccucaccgagcgcggcgucgaggucgucaacgccaccgagaccgucgagcgcaccaacaucccccgcaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaaggaggaggcccuccgccagauccuccgcgaguccggcggcaucgacaaggaggccaugggcuucaccuacuccggcauccgcaccaacggcgccaccuccgccugccgccgcuccggcuccuccuucuacgccgagaugaaguggcuccucuccaacaccgacaacgccgccuucccccagaugaccaaguccuacaagaacacccgcaagucccccgcccucaucgucuggggcauccaccacuccgucuccaccgccgagcagaccaagcucuacggcuccggcaacaagcucgucaccgucggcuccuccaacuaccagcaguccuucguccccucccccggcgcccgcccccaggucaacggccucuccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacuccggcggcaccaucaucuccaaccuccccuuccagaacaucgacucccgcgccgucggcaagugcccccgcuacgucaagcagcgcucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucgaccagaucaccggcaagcucaaccgccucaucgagaagaccaaccagcaguucgagcucaucgacaacgaguucaacgaggucgagaagcagaucggcaacgucaucaacuggacccgcgacuccaucaccgaggucugguccuacaacgccgagcuccucgucgccauggagaaccagcacaccaucgaccucgccgacuccgagauggacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgucaugggccucgucuucaucugcgucaagaacggcaacaugcgcugcaccaucugcaucuga

SEQ ID NO: 103334 - RNA, 1683 nt, Artificial Sequence; identical to SEQ ID NO: 101500
  derived and/or modified sequence opt2 from hemagglutinin__InfluenzaA__AHM24236

SEQ ID NO: 103335 - RNA, 1683 nt, Artificial Sequence; identical to SEQ ID NO: 101500
  derived and/or modified sequence opt2 from hemagglutinin__InfluenzaA__AHM24248

SEQ ID NO: 103336 - RNA, 1701 nt, Artificial Sequence
  derived and/or modified sequence opt2 from hemagglutinin__InfluenzaA__AHM98309
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgaggucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103337 - RNA, 1710 nt, Artificial Sequence
  derived and/or modified sequence opt2 from hemagglutinin__InfluenzaA__AHM98339
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccucaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103338 - RNA, 1701 nt, Artificial Sequence
  derived and/or modified sequence opt2 from hemagglutinin__InfluenzaA__AHM98350
augaaggccauccucgucgucaugcucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacgccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103339 - RNA, 1701 nt, Artificial Sequence; identical to SEQ ID NO: 97966
  derived and/or modified sequence opt2 from hemagglutinin__InfluenzaA__AHM98361

SEQ ID NO: 103340 - RNA, 1701 nt, Artificial Sequence; identical to SEQ ID NO: 98379
  derived and/or modified sequence opt2 from hemagglutinin__InfluenzaA__AHM98372

SEQ ID NO: 103341 - RNA, 1701 nt, Artificial Sequence; identical to SEQ ID NO: 98379
  derived and/or modified sequence opt2 from hemagglutinin__InfluenzaA__AHM98383

SEQ ID NO: 103342 - RNA, 1701 nt, Artificial Sequence; identical to SEQ ID NO: 98336
  derived and/or modified sequence opt2 from hemagglutinin__InfluenzaA__AHM98394

SEQ ID NO: 103343 - RNA, 1701 nt, Artificial Sequence
  derived and/or modified sequence opt2 from hemagglutinin__InfluenzaA__AHM98405
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucaagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103344 - RNA, 1701 nt, Artificial Sequence; identical to SEQ ID NO: 103343
  derived and/or modified sequence opt2 from hemagglutinin__InfluenzaA__AHM98416

SEQ ID NO: 103345 - RNA, 1701 nt, Artificial Sequence; identical to SEQ ID NO: 98336
  derived and/or modified sequence opt2 from hemagglutinin__InfluenzaA__AHM98427

SEQ ID NO: 103346 - RNA, 1701 nt, Artificial Sequence; identical to SEQ ID NO: 98554
  derived and/or modified sequence opt2 from hemagglutinin__InfluenzaA__AHM98438

SEQ ID NO: 103347 - RNA, 1701 nt, Artificial Sequence; identical to SEQ ID NO: 99698
  derived and/or modified sequence opt2 from hemagglutinin__InfluenzaA__AHM98449

SEQ ID NO: 103348 - RNA, 1701 nt, Artificial Sequence
  derived and/or modified sequence opt2 from hemagglutinin__InfluenzaA__AHM98460
augaaggccauccucgucguccuccucugcaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacaccaccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103349 - RNA, 1701 nt, Artificial Sequence; identical to SEQ ID NO: 98379
  derived and/or modified sequence opt2 from hemagglutinin__InfluenzaA__AHM98471

SEQ ID NO: 103350 - RNA, 1701 nt, Artificial Sequence
  derived and/or modified sequence opt2 from hemagglutinin__InfluenzaA__AHM98482
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgacaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103351 - RNA, 1701 nt, Artificial Sequence
  derived and/or modified sequence opt2 from hemagglutinin__InfluenzaA__AHM98493
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccguccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaaguaccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103352 - RNA, 1701 nt, Artificial Sequence
  derived and/or modified sequence opt2 from hemagglutinin__InfluenzaA__AHM98504
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccaaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103353 - RNA, 1701 nt, Artificial Sequence; identical to SEQ ID NO: 97966
  derived and/or modified sequence opt2 from hemagglutinin__InfluenzaA__AHM98515

SEQ ID NO: 103354 - RNA, 1701 nt, Artificial Sequence
  derived and/or modified sequence opt2 from hemagglutinin__InfluenzaA__AHM98526
augaaggccauccucgucguccuccuccacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccuccgcuccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucauccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103355 - RNA, 1701 nt, Artificial Sequence; identical to SEQ ID NO: 97966
  derived and/or modified sequence opt2 from hemagglutinin__InfluenzaA__AHM98537

SEQ ID NO: 103356 - RNA, 1701 nt, Artificial Sequence
  derived and/or modified sequence opt2 from hemagglutinin__InfluenzaA__AHM98548
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccgucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103357 - RNA, 1701 nt, Artificial Sequence
  derived and/or modified sequence opt2 from hemagglutinin__InfluenzaA__AHM98559
augaaggccauccucgucguccuccucuacaccuucgccaccgccaaggccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103358 - RNA, 1701 nt, Artificial Sequence; identical to SEQ ID NO: 98336
  derived and/or modified sequence opt2 from hemagglutinin__InfluenzaA__AHM98570

SEQ ID NO: 103359 - RNA, 1701 nt, Artificial Sequence
  derived and/or modified sequence opt2 from hemagglutinin__InfluenzaA__AHM98581
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgcccgcuccugguccuacaucgucgagaccuccuccuccgacaacggcaccugcuaccccggcgacuucaucgacuacgaggagcuccgcgagcagcucuccuccgucuccuccuucaagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103360 - RNA, 1701 nt, Artificial Sequence; identical to SEQ ID NO: 98336
  derived and/or modified sequence opt2 from hemagglutinin__InfluenzaA__AHM98592

SEQ ID NO: 103361 - RNA, 1701 nt, Artificial Sequence; identical to SEQ ID NO: 98379
  derived and/or modified sequence opt2 from hemagglutinin__InfluenzaA__AHM98603

SEQ ID NO: 103362 - RNA, 1701 nt, Artificial Sequence; identical to SEQ ID NO: 97966
  derived and/or modified sequence opt2 from hemagglutinin__InfluenzaA__AHM98614

SEQ ID NO: 103363 - RNA, 1701 nt, Artificial Sequence; identical to SEQ ID NO: 103343
  derived and/or modified sequence opt2 from hemagglutinin__InfluenzaA__AHM98625

SEQ ID NO: 103364 - RNA, 1701 nt, Artificial Sequence; identical to SEQ ID NO: 103343
  derived and/or modified sequence opt2 from hemagglutinin__InfluenzaA__AHM98636

SEQ ID NO: 103365 - RNA, 1701 nt, Artificial Sequence
  derived and/or modified sequence opt2 from hemagglutinin__InfluenzaA__AHM98647
augaaggccauccucgucguccuccucuacaccuucgccaccgccaaggccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103366 - RNA, 1701 nt, Artificial Sequence; identical to SEQ ID NO: 98379
  derived and/or modified sequence opt2 from hemagglutinin__InfluenzaA__AHM98658

SEQ ID NO: 103367 - RNA, 1701 nt, Artificial Sequence; identical to SEQ ID NO: 98336
  derived and/or modified sequence opt2 from hemagglutinin__InfluenzaA__AHM98669

SEQ ID NO: 103368 - RNA, 1701 nt, Artificial Sequence; identical to SEQ ID NO: 99698
  derived and/or modified sequence opt2 from hemagglutinin__InfluenzaA__AHM98701

SEQ ID NO: 103369 - RNA, 1701 nt, Artificial Sequence; identical to SEQ ID NO: 99698
  derived and/or modified sequence opt2 from hemagglutinin__InfluenzaA__AHM98712

SEQ ID NO: 103370 - RNA, 1701 nt, Artificial Sequence
  derived and/or modified sequence opt2 from hemagglutinin__InfluenzaA__AHM98723
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaacugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagauccuccccaagaccuccuccuggcccaaccacgacuccaacaagggcgucaccgccgccugcccccaggccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccguccgccccaagguccgcgaccaggagggccgcaugaacuacuacuggacccucaucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgcccagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuacccccgcuacuccgaggaggccaagcucaaccgcgaggagaucgacggcgucaagcucgaguccacccgcaucuaccagauccucgccaucuacuccaccgucgccuccucccucguccucaucgucucccucggcgccaucuccuucuggaugugcuccaacggcucccuccagugccgcaucugcaucuga

SEQ ID NO: 103371 - RNA, 1701 nt, Artificial Sequence
  derived and/or modified sequence opt2 from hemagglutinin__InfluenzaA__AHM98734
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagacccucuccaccgccuccuccugguccuacaucgucgagaccuccaacuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcuccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcgacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 103372 - RNA, 1701 nt, Artificial Sequence; identical to SEQ ID NO: 99698
  derived and/or modified sequence opt2 from hemagglutinin__InfluenzaA__AHM98745

SEQ ID NO: 103373 - RNA, 1701 nt, Artificial Sequence
  derived and/or modified sequence opt2 from hemagglutinin__InfluenzaA__AHM98756
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagacccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcgacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgucaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 103374 - RNA, 1701 nt, Artificial Sequence; identical to SEQ ID NO: 99698
  derived and/or modified sequence opt2 from hemagglutinin__InfluenzaA__AHM98767

SEQ ID NO: 103375 - RNA, 1701 nt, Artificial Sequence
  derived and/or modified sequence opt2 from hemagglutinin__InfluenzaA__AHM98778
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaaccgcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccgcgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103376 - RNA, 1701 nt, Artificial Sequence; identical to SEQ ID NO: 98562
  derived and/or modified sequence opt2 from hemagglutinin__InfluenzaA__AHM98798

SEQ ID NO: 103377 - RNA, 1701 nt, Artificial Sequence; identical to SEQ ID NO: 98336
  derived and/or modified sequence opt2 from hemagglutinin__InfluenzaA__AHM98809

SEQ ID NO: 103378 - RNA, 1701 nt, Artificial Sequence; identical to SEQ ID NO: 98336
  derived and/or modified sequence opt2 from hemagglutinin__InfluenzaA__AHM98820

SEQ ID NO: 103379 - RNA, 1701 nt, Artificial Sequence; identical to SEQ ID NO: 98336
  derived and/or modified sequence opt2 from hemagglutinin__InfluenzaA__AHM98831

SEQ ID NO: 103380 - RNA, 1701 nt, Artificial Sequence
  derived and/or modified sequence opt2 from hemagglutinin__InfluenzaA__AHM98836
augaaggccauccucgucgucaugcucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggauccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103381 - RNA, 1701 nt, Artificial Sequence
  derived and/or modified sequence opt2 from hemagglutinin__InfluenzaA__AHM98847
augaaggccauccucgucgucaugcucuacaccuucgccaccgccaacgccgacacccucugcaucggcuaccacgccaacaacuccaccgacaccgucgacaccguccucgagaagaacgucaccgucacccacuccgucaaccuccucgaggacaagcacgacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103382 - RNA, 1701 nt, Artificial Sequence; identical to SEQ ID NO: 98336
  derived and/or modified sequence opt2 from hemagglutinin__InfluenzaA__AHM98858

SEQ ID NO: 103383 - RNA, 1701 nt, Artificial Sequence; identical to SEQ ID NO: 98379
  derived and/or modified sequence opt2 from hemagglutinin__InfluenzaA__AHM98877

SEQ ID NO: 103384 - RNA, 1701 nt, Artificial Sequence
  derived and/or modified sequence opt2 from hemagglutinin__InfluenzaA__AHM98898
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaaccacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103385 - RNA, 1701 nt, Artificial Sequence; identical to SEQ ID NO: 101962
  derived and/or modified sequence opt2 from hemagglutinin__InfluenzaA__AHM98909

SEQ ID NO: 103386 - RNA, 1701 nt, Artificial Sequence
  derived and/or modified sequence opt2 from hemagglutinin__InfluenzaA__AHM98932
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcucggcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcgacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccgcgagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103387 - RNA, 1701 nt, Artificial Sequence; identical to SEQ ID NO: 103386
  derived and/or modified sequence opt2 from hemagglutinin__InfluenzaA__AHM98940

SEQ ID NO: 103388 - RNA, 1701 nt, Artificial Sequence; identical to SEQ ID NO: 103386
  derived and/or modified sequence opt2 from hemagglutinin__InfluenzaA__AHM98951

SEQ ID NO: 103389 - RNA, 1701 nt, Artificial Sequence
  derived and/or modified sequence opt2 from hemagglutinin__InfluenzaA__AHM98975
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgaguccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103390 - RNA, 1701 nt, Artificial Sequence
  derived and/or modified sequence opt2 from hemagglutinin__InfluenzaA__AHM98997
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcgacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcggccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103391 - RNA, 1701 nt, Artificial Sequence
  derived and/or modified sequence opt2 from hemagglutinin__InfluenzaA__AHM99019
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcucaagggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcgacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcggccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103392 - RNA, 1701 nt, Artificial Sequence; identical to SEQ ID NO: 103391
  derived and/or modified sequence opt2 from hemagglutinin__InfluenzaA__AHM99031

SEQ ID NO: 103393 - RNA, 1701 nt, Artificial Sequence; identical to SEQ ID NO: 103391
  derived and/or modified sequence opt2 from hemagglutinin__InfluenzaA__AHM99043

SEQ ID NO: 103394 - RNA, 1701 nt, Artificial Sequence; identical to SEQ ID NO: 103391
  derived and/or modified sequence opt2 from hemagglutinin__InfluenzaA__AHM99054

SEQ ID NO: 103395 - RNA, 1701 nt, Artificial Sequence; identical to SEQ ID NO: 103391
  derived and/or modified sequence opt2 from hemagglutinin__InfluenzaA__AHM99065

SEQ ID NO: 103396 - RNA, 1701 nt, Artificial Sequence
  derived and/or modified sequence opt2 from hemagglutinin__InfluenzaA__AHM99075
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcgacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103397 - RNA, 1701 nt, Artificial Sequence
  derived and/or modified sequence opt2 from hemagglutinin__InfluenzaA__AHN00717
augaaggccauccuccucguccuccucugcaccuucgccgccaccaacgccgacacccucugcaucggcuaccacgccaacaacuccaccgacaccgucgacaccguccucgagaagaacgucaccgucacccacuccgucaaccuccucgaggaccgccacaacggcaagcucugcaagcucggcggcaucgccccccuccaccucggcaagugcaacaucgccggcuggcuccucggcaaccccgagugcgagcuccucuucaccgucuccuccugguccuacaucgucgagaccuccaacuccgacaacggcaccugcuaccccggcgacuucaucaacuacgaggagcuccgcgagcagcucuccuccgucuccuccuucgagcgcuucgagaucuuccccaagaccuccuccuggcccaaccacgagaccaaccgcggcgucaccgccgccugccccuacgccggcgccaacuccuucuaccgcaaccucaucuggcucgucaagaagggcaacuccuaccccaagcucuccaaguccuacgucaacaacaagggcaaggagguccucguccucuggggcauccaccacccccccaccuccaccgaccagcagucccucuaccagaacgccgacgccuacgucuucgucggcuccuccaaguacaaccgcaaguucaagcccgagaucgccgcccgccccaagguccgcggccaggccggccgcaugaacuacuacuggacccucaucgagcccggcgacaccaucaccuucgaggccaccggcaaccucgucgucccccgcuacgccuucgccaugaaccgcggccccggcuccggcaucaucaucuccgacgcccccguccacgacugcaacaccaccugccagacccccaagggcgccaucaacaccucccuccccuuccagaacauccaccccgucaccaucggcgagugccccaaguacgucaaguccaccaagcuccgcauggccaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucgacggcaucaccaacaaggucaacuccgucaucaagaagaugaacacccaguucaccgccgucggcaaggaguucaaccaccucgagaagcgcaucgagaaccucaacaagaaggucgacgacggcuuccucgacgucuggaccuacaacgccgagcuccucguccuccucgagaacgagcgcacccucgacuuccacgacuccaacgucaagaaccucuacgagaagguccgcucccagcuccgcaacaacgccaaggagaucggcaacggcugcuucgaguucuaccacaagugcgacgacaccugcauggaguccgucaagaacggcaccuacgacuaccccaaguacuccgaggaguccaagcucaaccgcgaggagaucgacggcgucaagcucgaguccacccgcaucuaccagauccucgccaucuacuccaccgccgccuccucccucguccuccucgucucccucggcgccaucuccuucuggaugugcuccaacggcucccuccagugccgcaucugcaucuga

SEQ ID NO: 103398 - RNA, 1701 nt, Artificial Sequence
  derived and/or modified sequence opt2 from hemagglutinin__InfluenzaA__AHN00764
augaaggccauccuccucguccuccucugcaccuucgccgccaccaacgccgacacccucugcaucggcuaccacgccaacaacuccaccgacaccgucgacaccguccucgagaagaacgucaccgucacccacuccgucaaccuccucgaggacaagcacaacggcaagcucugcaagcucggcggcaucgccccccuccaccucggcaagugcaacaucgccggcuggcuccucggcaaccccgagugcgagcuccucuucaccgucuccuccugguccuacaucgucgagaccuccaacuccgacaacggcaccugcuaccccggcgacuucaucaacuacgaggagcuccgcgagcagcucuccuccgucuccuccuucgagcgcuucgagaucuuccccaagaccuccuccuggcccaaccacgagaccaaccgcggcgucaccgccgccugccccuacgccggcgccaacuccuucuaccgcaaccucaucuggcucgucaagaagggcaacuccuaccccaagcucuccaaguccuacgucaacaacaagggcaaggagguccucguccucuggggcauccaccacccccccaccuccaccgaccagcagucccucuaccagaacgccgacgccuacgucuucgucggcuccuccaaguacaaccgcaaguucaagcccgagaucgccgcccgccccaagguccgcggccaggccggccgcaugaacuacuacuggacccucaucgagcccggcgacaccaucaccuucgaggccaccggcaaccucgucgucccccgcuacgccuucgccaugaaccgcggccccggcuccggcaucaucaucuccgacgcccccguccacgacugcaacaccaccugccagacccccaagggcgccaucaacaccucccuccccuuccagaacauccaccccgucaccaucggcgagugccccaaguacgucaaguccaccaagcuccgcauggccaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgaccagaaguccacccagaacgccaucgacggcaucaccaacaaggucaacuccgucaucaagaagaugaacacccaguucaccgccgucggcaaggaguucaaccaccucgagaagcgcaucgagaaccucaacaagaaggucgacgacggcuuccucgacgucuggaccuacaacgccgagcuccucguccuccucgagaacgagcgcacccucgacuuccacgacuccaacgucaagaaccucuacgagaagguccgcucccagcuccgcaacaacgccaaggagaucggcaacggcugcuucgaguucuaccacaagugcgacgacaccugcauggaguccgucaagaacggcaccuacgacuaccccaaguacuccgaggaguccaagcucaaccgcgaggagaucgacggcgucaagcucgaguccacccgcaucuaccagauccucgccaucuacuccaccgccgccuccucccucguccuccucgucucccucggcgccaucuccuucuggaugugcuccaacggcucccuccagugccgcaucugcaucuga

SEQ ID NO: 103399 - RNA, 1683 nt, Artificial Sequence
  derived and/or modified sequence opt2 from hemagglutinin__InfluenzaA__AHN96323
augaacacccagauccucgucuucgcccucaucgccaucauccccaccaacgccgacaagaucugccucggccaccacgccgucuccaacggcaccaaggucaacacccucaccgagcgcggcgucgaggucgucaacgccaccgagaccgucgagcgcaccaacaucccccgcaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggaggccaugggcuucaccuacuccggcauccgcaccaacggcgccaccuccgccugccgccgcuccggcuccuccuucuacgccgagaugaaguggcuccucuccaacaccgacaacgccgccuucccccagaugaccaaguccuacaagaacacccgcaagucccccgcccucaucgucuggggcauccaccacuccgucuccaccgccgagcagaccaagcucuacggcuccggcaacaagcucgucaccgucggcuccuccaacuaccagcaguccuucguccccucccccggcgcccgcccccaggucaacggccucuccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacuccggcggcaccaucaucuccaaccuccccuuccagaacaucgacucccgcgccgucggcaagugcccccgcuacgucaagcagcgcucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucgaccagaucaccggcaagcucaaccgccucaucgagaagaccaaccagcaguucgagcucaucgacaacgaguucaacgaggucgagaagcagaucggcaacgucaucaacuggacccgcgacuccaucaccgaggucugguccuacaacgccgagcuccucgucgccauggagaaccagcacaccaucgaccucgccgacuccgagauggacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgucaugggccucgucuucaucugcgucaagaacggcaacaugcgcugcaccaucggcaucuga

SEQ ID NO: 103400 - RNA, 1701 nt, Artificial Sequence; identical to SEQ ID NO: 98494
  derived and/or modified sequence opt2 from hemagglutinin__InfluenzaA__AHN96442

SEQ ID NO: 103401 - RNA, 1701 nt, Artificial Sequence
  derived and/or modified sequence opt2 from hemagglutinin__InfluenzaA__AHN96443
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacaccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103402 - RNA, 1701 nt, Artificial Sequence
  derived and/or modified sequence opt2 from hemagglutinin__InfluenzaA__AHN96444
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaaccagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcaucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103403 - RNA, 1701 nt, Artificial Sequence
  derived and/or modified sequence opt2 from hemagglutinin__InfluenzaA__AHN96445
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaaccagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccucuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103404 - RNA, 1701 nt, Artificial Sequence
  derived and/or modified sequence opt2 from hemagglutinin__InfluenzaA__AHN96447
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 103405 - RNA, 1701 nt, Artificial Sequence
  derived and/or modified sequence opt2 from hemagglutinin__InfluenzaA__AHV83765
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaccaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103406 - RNA, 1701 nt, Artificial Sequence; identical to SEQ ID NO: 102533
  derived and/or modified sequence opt2 from hemagglutinin__InfluenzaA__AHV83766

SEQ ID NO: 103407 - RNA, 1701 nt, Artificial Sequence; identical to SEQ ID NO: 101552
  derived and/or modified sequence opt2 from hemagglutinin__InfluenzaA__AHV83767

SEQ ID NO: 103408 - RNA, 1701 nt, Artificial Sequence
  derived and/or modified sequence opt2 from hemagglutinin__InfluenzaA__AHV83768
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccuccucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggacuccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103409 - RNA, 1701 nt, Artificial Sequence; identical to SEQ ID NO: 102510
  derived and/or modified sequence opt2 from hemagglutinin__InfluenzaA__AHV83770

SEQ ID NO: 103410 - RNA, 1701 nt, Artificial Sequence
  derived and/or modified sequence opt2 from hemagglutinin__InfluenzaA__AHV83771
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccaccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103411 - RNA, 1701 nt, Artificial Sequence; identical to SEQ ID NO: 101552
  derived and/or modified sequence opt2 from hemagglutinin__InfluenzaA__AHV83772

SEQ ID NO: 103412 - RNA, 1701 nt, Artificial Sequence; identical to SEQ ID NO: 101552
  derived and/or modified sequence opt2 from hemagglutinin__InfluenzaA__AHV83773

SEQ ID NO: 103413 - RNA, 1701 nt, Artificial Sequence; identical to SEQ ID NO: 101552
  derived and/or modified sequence opt2 from hemagglutinin__InfluenzaA__AHV83774

SEQ ID NO: 103414 - RNA, 1701 nt, Artificial Sequence
  derived and/or modified sequence opt2 from hemagglutinin__InfluenzaA__AHV83775
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103415 - RNA, 1701 nt, Artificial Sequence; identical to SEQ ID NO: 101552
  derived and/or modified sequence opt2 from hemagglutinin__InfluenzaA__AHV83776

SEQ ID NO: 103416 - RNA, 1701 nt, Artificial Sequence
  derived and/or modified sequence opt2 from hemagglutinin__InfluenzaA__AHV83777
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucugcuucuggaugugcuccaacggcucccuccagugccgcaucugcaucuga

SEQ ID NO: 103417 - RNA, 1701 nt, Artificial Sequence
  derived and/or modified sequence opt2 from hemagglutinin__InfluenzaA__AHV83778
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccgucuacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103418 - RNA, 1701 nt, Artificial Sequence
  derived and/or modified sequence opt2 from hemagglutinin__InfluenzaA__AHV83779
augaaggccauccucgucguccuccucuacaccuucgccaccaccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaccggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103419 - RNA, 1701 nt, Artificial Sequence
  derived and/or modified sequence opt2 from hemagglutinin__InfluenzaA__AHV83780
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcuccgccaguccuacaucaacgacaagggcaaggagguccucguccucuggggcauccaccaccccuccaccaccaccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103420 - RNA, 1701 nt, Artificial Sequence; identical to SEQ ID NO: 101552
  derived and/or modified sequence opt2 from hemagglutinin__InfluenzaA__AHV83781

SEQ ID NO: 103421 - RNA, 1701 nt, Artificial Sequence
  derived and/or modified sequence opt2 from hemagglutinin__InfluenzaA__AHV83782
augaaggccauccucgucguccuccucuacacccucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgccccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103422 - RNA, 1701 nt, Artificial Sequence
  derived and/or modified sequence opt2 from hemagglutinin__InfluenzaA__AHV83783
augaaggccauccucgucguccuccucuacaccuucgccaccgccaacgccgacacccucugcaucggcuaccacgccaacaacuccaccgacaccgucgacaccguccucgagaagaacaucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcuccgccaguccuacaucaacgacaagggcaaggagguccucguccucuggggcauccaccaccccuccaccaccaccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103423 - RNA, 1701 nt, Artificial Sequence; identical to SEQ ID NO: 101552
  derived and/or modified sequence opt2 from hemagglutinin__InfluenzaA__AHV83784

SEQ ID NO: 103424 - RNA, 1701 nt, Artificial Sequence; identical to SEQ ID NO: 101552
  derived and/or modified sequence opt2 from hemagglutinin__InfluenzaA__AHV83785

SEQ ID NO: 103425 - RNA, 1701 nt, Artificial Sequence; identical to SEQ ID NO: 101552
  derived and/or modified sequence opt2 from hemagglutinin__InfluenzaA__AHV83787

SEQ ID NO: 103426 - RNA, 1701 nt, Artificial Sequence
  derived and/or modified sequence opt2 from hemagglutinin__InfluenzaA__AHV83788
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucuccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucgucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103427 - RNA, 1701 nt, Artificial Sequence; identical to SEQ ID NO: 103414
  derived and/or modified sequence opt2 from hemagglutinin__InfluenzaA__AHV83789

SEQ ID NO: 103428 - RNA, 1701 nt, Artificial Sequence; identical to SEQ ID NO: 101552
  derived and/or modified sequence opt2 from hemagglutinin__InfluenzaA__AHV83790

SEQ ID NO: 103429 - RNA, 1701 nt, Artificial Sequence; identical to SEQ ID NO: 101552
  derived and/or modified sequence opt2 from hemagglutinin__InfluenzaA__AHV83791

SEQ ID NO: 103430 - RNA, 1701 nt, Artificial Sequence; identical to SEQ ID NO: 101552
  derived and/or modified sequence opt2 from hemagglutinin__InfluenzaA__AHV83792

SEQ ID NO: 103431 - RNA, 1701 nt, Artificial Sequence
  derived and/or modified sequence opt2 from hemagglutinin__InfluenzaA__AHV83793
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagaaguucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagauccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103432 - RNA, 1701 nt, Artificial Sequence
  derived and/or modified sequence opt2 from hemagglutinin__InfluenzaA__AHV83794
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103433 - RNA, 1701 nt, Artificial Sequence
  derived and/or modified sequence opt2 from hemagglutinin__InfluenzaA__AHV83795
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccgccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccaccaagaucuaccagauccucgccaucuacuccaccgucgccuccucccucguccucgucgucucccucggcgccaucuccuucuggaugugcuccaacggcucccuccagugccgcaucugcaucuga

SEQ ID NO: 103434 - RNA, 1701 nt, Artificial Sequence; identical to SEQ ID NO: 103432
  derived and/or modified sequence opt2 from hemagglutinin__InfluenzaA__AHV83796

SEQ ID NO: 103435 - RNA, 1701 nt, Artificial Sequence; identical to SEQ ID NO: 101552
  derived and/or modified sequence opt2 from hemagglutinin__InfluenzaA__AHV83798

SEQ ID NO: 103436 - RNA, 1701 nt, Artificial Sequence; identical to SEQ ID NO: 101552
  derived and/or modified sequence opt2 from hemagglutinin__InfluenzaA__AHV83799

SEQ ID NO: 103437 - RNA, 1701 nt, Artificial Sequence
  derived and/or modified sequence opt2 from hemagglutinin__InfluenzaA__AHV83800
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagaagacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103438 - RNA, 1701 nt, Artificial Sequence
  derived and/or modified sequence opt2 from hemagglutinin__InfluenzaA__AHV83801
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccaccaagaucuaccagauccucgccaucuacuccaccgucgccuccucccucguccucgucgucucccucggcgccaucuccuucuggaugugcuccaacggcucccuccagugccgcaucugcaucuga

SEQ ID NO: 103439 - RNA, 1701 nt, Artificial Sequence
  derived and/or modified sequence opt2 from hemagglutinin__InfluenzaA__AHV83802
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagggccucuaccagaacgucgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103440 - RNA, 1701 nt, Artificial Sequence; identical to SEQ ID NO: 101552
  derived and/or modified sequence opt2 from hemagglutinin__InfluenzaA__AHV83803

SEQ ID NO: 103441 - RNA, 1701 nt, Artificial Sequence; identical to SEQ ID NO: 101552
  derived and/or modified sequence opt2 from hemagglutinin__InfluenzaA__AHV83804

SEQ ID NO: 103442 - RNA, 1701 nt, Artificial Sequence; identical to SEQ ID NO: 101552
  derived and/or modified sequence opt2 from hemagglutinin__InfluenzaA__AHV83805

SEQ ID NO: 103443 - RNA, 1701 nt, Artificial Sequence; identical to SEQ ID NO: 103432
  derived and/or modified sequence opt2 from hemagglutinin__InfluenzaA__AHV83806

SEQ ID NO: 103444 - RNA, 1701 nt, Artificial Sequence
  derived and/or modified sequence opt2 from hemagglutinin__InfluenzaA__AHV83807
augaaggccauccucgucguccuccucuacaccuucgccaccgccaacgccgacacccucugcaucggcuaccacgccaacaacuccaccgacaccgucgacaccguccucgagaaggacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103445 - RNA, 1701 nt, Artificial Sequence
  derived and/or modified sequence opt2 from hemagglutinin__InfluenzaA__AHV83808
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgaggccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaugugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103446 - RNA, 1701 nt, Artificial Sequence; identical to SEQ ID NO: 101552
  derived and/or modified sequence opt2 from hemagglutinin__InfluenzaA__AHV83809

SEQ ID NO: 103447 - RNA, 1701 nt, Artificial Sequence; identical to SEQ ID NO: 102533
  derived and/or modified sequence opt2 from hemagglutinin__InfluenzaA__AHV83810

SEQ ID NO: 103448 - RNA, 1701 nt, Artificial Sequence
  derived and/or modified sequence opt2 from hemagglutinin__InfluenzaA__AHV83812
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgaguaccccaaguacuccgaggaggccaagcucaaccgcgagaagaucgacggcgucaagcucgaguccaccaagaucuaccagauccucgccaucuacuccaccgucgccuccucccucguccucgucgucucccucggcgccaucuccuucuggaugugcuccaacggcucccuccagugccgcaucugcaucuga

SEQ ID NO: 103449 - RNA, 1701 nt, Artificial Sequence; identical to SEQ ID NO: 101552
  derived and/or modified sequence opt2 from hemagglutinin__InfluenzaA__AHV83813

SEQ ID NO: 103450 - RNA, 1701 nt, Artificial Sequence
  derived and/or modified sequence opt2 from hemagglutinin__InfluenzaA__AHV83814
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcaaccucgacuaccacgacuccaacgucaagaaccucuacgagaagguccgcaaccagcucaagaccaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103451 - RNA, 1701 nt, Artificial Sequence; identical to SEQ ID NO: 102533
  derived and/or modified sequence opt2 from hemagglutinin__InfluenzaA__AHV83815

SEQ ID NO: 103452 - RNA, 1701 nt, Artificial Sequence; identical to SEQ ID NO: 101552
  derived and/or modified sequence opt2 from hemagglutinin__InfluenzaA__AHV83816

SEQ ID NO: 103453 - RNA, 1701 nt, Artificial Sequence
  derived and/or modified sequence opt2 from hemagglutinin__InfluenzaA__AHV83817
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucgucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103454 - RNA, 1701 nt, Artificial Sequence; identical to SEQ ID NO: 103432
  derived and/or modified sequence opt2 from hemagglutinin__InfluenzaA__AHV83818

SEQ ID NO: 103455 - RNA, 1701 nt, Artificial Sequence; identical to SEQ ID NO: 103414
  derived and/or modified sequence opt2 from hemagglutinin__InfluenzaA__AHV83819

SEQ ID NO: 103456 - RNA, 1701 nt, Artificial Sequence
  derived and/or modified sequence opt2 from hemagglutinin__InfluenzaA__AHV83821
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucuccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucgucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacaacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103457 - RNA, 1701 nt, Artificial Sequence
  derived and/or modified sequence opt2 from hemagglutinin__InfluenzaA__AHV83822
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucuccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucgucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccaucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103458 - RNA, 1701 nt, Artificial Sequence
  derived and/or modified sequence opt2 from hemagglutinin__InfluenzaA__AHV83823
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagaucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacaccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103459 - RNA, 1701 nt, Artificial Sequence
  derived and/or modified sequence opt2 from hemagglutinin__InfluenzaA__AHV83824
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcuccgccaguccuacaucaacgacaagggcaaggagguccucguccucuggggcauccaccaccccuccaccaccaccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcaaccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103460 - RNA, 1701 nt, Artificial Sequence; identical to SEQ ID NO: 103432
  derived and/or modified sequence opt2 from hemagglutinin__InfluenzaA__AHV83825

SEQ ID NO: 103461 - RNA, 1701 nt, Artificial Sequence
  derived and/or modified sequence opt2 from hemagglutinin__InfluenzaA__AHV83826
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacuucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 103462 - RNA, 1701 nt, Artificial Sequence; identical to SEQ ID NO: 101552
  derived and/or modified sequence opt2 from hemagglutinin__InfluenzaA__AHV83827

SEQ ID NO: 103463 - RNA, 1701 nt, Artificial Sequence; identical to SEQ ID NO: 101552
  derived and/or modified sequence opt2 from hemagglutinin__InfluenzaA__AHV83828

SEQ ID NO: 103464 - RNA, 1701 nt, Artificial Sequence
  derived and/or modified sequence opt2 from hemagglutinin__InfluenzaA__AHV83829
auggaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagaucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103465 - RNA, 1701 nt, Artificial Sequence; identical to SEQ ID NO: 101552
  derived and/or modified sequence opt2 from hemagglutinin__InfluenzaA__AHV83830

SEQ ID NO: 103466 - RNA, 1701 nt, Artificial Sequence
  derived and/or modified sequence opt2 from hemagglutinin__InfluenzaA__AHV83831
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaucgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucgucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103467 - RNA, 1701 nt, Artificial Sequence; identical to SEQ ID NO: 102515
  derived and/or modified sequence opt2 from hemagglutinin__InfluenzaA__AHV83832

SEQ ID NO: 103468 - RNA, 1701 nt, Artificial Sequence; identical to SEQ ID NO: 101552
  derived and/or modified sequence opt2 from hemagglutinin__InfluenzaA__AHV83833

SEQ ID NO: 103469 - RNA, 1701 nt, Artificial Sequence; identical to SEQ ID NO: 102533
  derived and/or modified sequence opt2 from hemagglutinin__InfluenzaA__AHV83834

SEQ ID NO: 103470 - RNA, 1701 nt, Artificial Sequence
  derived and/or modified sequence opt2 from hemagglutinin__InfluenzaA__AHV83836
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaaggagaacuccuaccccaagcuccgccaguccuacaucaacgacaagggcaaggagguccucguccucuggggcauccaccaccccuccaccaccaccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103471 - RNA, 1701 nt, Artificial Sequence; identical to SEQ ID NO: 103419
  derived and/or modified sequence opt2 from hemagglutinin__InfluenzaA__AHV83837

SEQ ID NO: 103472 - RNA, 1701 nt, Artificial Sequence; identical to SEQ ID NO: 101552
  derived and/or modified sequence opt2 from hemagglutinin__InfluenzaA__AHV83838

SEQ ID NO: 103473 - RNA, 1701 nt, Artificial Sequence; identical to SEQ ID NO: 102515
  derived and/or modified sequence opt2 from hemagglutinin__InfluenzaA__AHV83839

SEQ ID NO: 103474 - RNA, 1701 nt, Artificial Sequence; identical to SEQ ID NO: 102533
  derived and/or modified sequence opt2 from hemagglutinin__InfluenzaA__AHV83840

SEQ ID NO: 103475 - RNA, 1701 nt, Artificial Sequence
  derived and/or modified sequence opt2 from hemagglutinin__InfluenzaA__AHV83841
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcuccgccaguccuacaucaacgacaagggcaaggagguccucguccucuggggcauccaccaccccuccaccaccaccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacaacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103476 - RNA, 1701 nt, Artificial Sequence; identical to SEQ ID NO: 101552
  derived and/or modified sequence opt2 from hemagglutinin__InfluenzaA__AHV83842

SEQ ID NO: 103477 - RNA, 1701 nt, Artificial Sequence; identical to SEQ ID NO: 101552
  derived and/or modified sequence opt2 from hemagglutinin__InfluenzaA__AHV83843

SEQ ID NO: 103478 - RNA, 1701 nt, Artificial Sequence; identical to SEQ ID NO: 101552
  derived and/or modified sequence opt2 from hemagglutinin__InfluenzaA__AHV83844

SEQ ID NO: 103479 - RNA, 1701 nt, Artificial Sequence
  derived and/or modified sequence opt2 from hemagglutinin__InfluenzaA__AHV83845
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccacccccccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 103480 - RNA, 1701 nt, Artificial Sequence; identical to SEQ ID NO: 101552
  derived and/or modified sequence opt2 from hemagglutinin__InfluenzaA__AHV83846

SEQ ID NO: 103481 - RNA, 1701 nt, Artificial Sequence; identical to SEQ ID NO: 101552
  derived and/or modified sequence opt2 from hemagglutinin__InfluenzaA__AHV83847

SEQ ID NO: 103482 - RNA, 1701 nt, Artificial Sequence; identical to SEQ ID NO: 101552
  derived and/or modified sequence opt2 from hemagglutinin__InfluenzaA__AHV83848

SEQ ID NO: 103483 - RNA, 1701 nt, Artificial Sequence; identical to SEQ ID NO: 103405
  derived and/or modified sequence opt2 from hemagglutinin__InfluenzaA__AHV83849

SEQ ID NO: 103484 - RNA, 1701 nt, Artificial Sequence
  derived and/or modified sequence opt2 from hemagglutinin__InfluenzaA__AHV83850
augaaggccauccucgucguccuccucuacaccuucgccaccaccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaaggccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103485 - RNA, 1701 nt, Artificial Sequence; identical to SEQ ID NO: 101552
  derived and/or modified sequence opt2 from hemagglutinin__InfluenzaA__AHV83851

SEQ ID NO: 103486 - RNA, 1701 nt, Artificial Sequence; identical to SEQ ID NO: 101552
  derived and/or modified sequence opt2 from hemagglutinin__InfluenzaA__AHV83852

SEQ ID NO: 103487 - RNA, 1701 nt, Artificial Sequence
  derived and/or modified sequence opt2 from hemagglutinin__InfluenzaA__AHV83853
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagacccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcgacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcacccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 103488 - RNA, 1701 nt, Artificial Sequence; identical to SEQ ID NO: 103414
  derived and/or modified sequence opt2 from hemagglutinin__InfluenzaA__AHV83855

SEQ ID NO: 103489 - RNA, 1701 nt, Artificial Sequence
  derived and/or modified sequence opt2 from hemagglutinin__InfluenzaA__AHV83856
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggagaucgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103490 - RNA, 1701 nt, Artificial Sequence; identical to SEQ ID NO: 103414
  derived and/or modified sequence opt2 from hemagglutinin__InfluenzaA__AHV83857

SEQ ID NO: 103491 - RNA, 1701 nt, Artificial Sequence
  derived and/or modified sequence opt2 from hemagglutinin__InfluenzaA__AHV83858
augaaggccauccucgucguccuccucuacaccuucgccaccgccaacaccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103492 - RNA, 1701 nt, Artificial Sequence; identical to SEQ ID NO: 101552
  derived and/or modified sequence opt2 from hemagglutinin__InfluenzaA__AHV83859

SEQ ID NO: 103493 - RNA, 1701 nt, Artificial Sequence
  derived and/or modified sequence opt2 from hemagglutinin__InfluenzaA__AHV83861
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103494 - RNA, 1701 nt, Artificial Sequence; identical to SEQ ID NO: 103493
  derived and/or modified sequence opt2 from hemagglutinin__InfluenzaA__AHV83862

SEQ ID NO: 103495 - RNA, 1701 nt, Artificial Sequence; identical to SEQ ID NO: 101552
  derived and/or modified sequence opt2 from hemagglutinin__InfluenzaA__AHV83863

SEQ ID NO: 103496 - RNA, 1701 nt, Artificial Sequence; identical to SEQ ID NO: 101552
  derived and/or modified sequence opt2 from hemagglutinin__InfluenzaA__AHV83864

SEQ ID NO: 103497 - RNA, 1701 nt, Artificial Sequence
  derived and/or modified sequence opt2 from hemagglutinin__InfluenzaA__AHV83866
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccauccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacgacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103498 - RNA, 1701 nt, Artificial Sequence
  derived and/or modified sequence opt2 from hemagglutinin__InfluenzaA__AHV83867
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacgacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103499 - RNA, 1701 nt, Artificial Sequence; identical to SEQ ID NO: 101552
  derived and/or modified sequence opt2 from hemagglutinin__InfluenzaA__AHV83868

SEQ ID NO: 103500 - RNA, 1701 nt, Artificial Sequence
  derived and/or modified sequence opt2 from hemagglutinin__InfluenzaA__AHV83869
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccaacuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103501 - RNA, 1701 nt, Artificial Sequence; identical to SEQ ID NO: 101552
  derived and/or modified sequence opt2 from hemagglutinin__InfluenzaA__AHV83870

SEQ ID NO: 103502 - RNA, 1701 nt, Artificial Sequence; identical to SEQ ID NO: 101552
  derived and/or modified sequence opt2 from hemagglutinin__InfluenzaA__AHV83871

SEQ ID NO: 103503 - RNA, 1701 nt, Artificial Sequence; identical to SEQ ID NO: 101552
  derived and/or modified sequence opt2 from hemagglutinin__InfluenzaA__AHV83872

SEQ ID NO: 103504 - RNA, 1701 nt, Artificial Sequence
  derived and/or modified sequence opt2 from hemagglutinin__InfluenzaA__AHV83873
augaaggccauccucgucguccuccucuacaccuucgccaccaccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccgucgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103505 - RNA, 1701 nt, Artificial Sequence; identical to SEQ ID NO: 101552
  derived and/or modified sequence opt2 from hemagglutinin__InfluenzaA__AHV83874

SEQ ID NO: 103506 - RNA, 1701 nt, Artificial Sequence; identical to SEQ ID NO: 101552
  derived and/or modified sequence opt2 from hemagglutinin__InfluenzaA__AHV83875

SEQ ID NO: 103507 - RNA, 1701 nt, Artificial Sequence; identical to SEQ ID NO: 101552
  derived and/or modified sequence opt2 from hemagglutinin__InfluenzaA__AHV83876

SEQ ID NO: 103508 - RNA, 1701 nt, Artificial Sequence
  derived and/or modified sequence opt2 from hemagglutinin__InfluenzaA__AHV83877
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucaagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103509 - RNA, 1701 nt, Artificial Sequence; identical to SEQ ID NO: 103419
  derived and/or modified sequence opt2 from hemagglutinin__InfluenzaA__AHV83878

SEQ ID NO: 103510 - RNA, 1701 nt, Artificial Sequence; identical to SEQ ID NO: 103419
  derived and/or modified sequence opt2 from hemagglutinin__InfluenzaA__AHV83879

SEQ ID NO: 103511 - RNA, 1701 nt, Artificial Sequence
  derived and/or modified sequence opt2 from hemagglutinin__InfluenzaA__AHV83881
augaaggccacccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103512 - RNA, 1701 nt, Artificial Sequence; identical to SEQ ID NO: 102533
  derived and/or modified sequence opt2 from hemagglutinin__InfluenzaA__AHV83882

SEQ ID NO: 103513 - RNA, 1701 nt, Artificial Sequence; identical to SEQ ID NO: 102515
  derived and/or modified sequence opt2 from hemagglutinin__InfluenzaA__AHV83883

SEQ ID NO: 103514 - RNA, 1701 nt, Artificial Sequence; identical to SEQ ID NO: 101552
  derived and/or modified sequence opt2 from hemagglutinin__InfluenzaA__AHV83884

SEQ ID NO: 103515 - RNA, 1701 nt, Artificial Sequence
  derived and/or modified sequence opt2 from hemagglutinin__InfluenzaA__AHV83885
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccgucuacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103516 - RNA, 1701 nt, Artificial Sequence; identical to SEQ ID NO: 103432
  derived and/or modified sequence opt2 from hemagglutinin__InfluenzaA__AHV83887

SEQ ID NO: 103517 - RNA, 1701 nt, Artificial Sequence; identical to SEQ ID NO: 101552
  derived and/or modified sequence opt2 from hemagglutinin__InfluenzaA__AHV83888

SEQ ID NO: 103518 - RNA, 1701 nt, Artificial Sequence
  derived and/or modified sequence opt2 from hemagglutinin__InfluenzaA__AHV83889
augaaggccauccucgucguccuccuccacacccucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103519 - RNA, 1701 nt, Artificial Sequence; identical to SEQ ID NO: 101552
  derived and/or modified sequence opt2 from hemagglutinin__InfluenzaA__AHV83890

SEQ ID NO: 103520 - RNA, 1701 nt, Artificial Sequence; identical to SEQ ID NO: 101552
  derived and/or modified sequence opt2 from hemagglutinin__InfluenzaA__AHV83891

SEQ ID NO: 103521 - RNA, 1701 nt, Artificial Sequence; identical to SEQ ID NO: 101552
  derived and/or modified sequence opt2 from hemagglutinin__InfluenzaA__AHV83893

SEQ ID NO: 103522 - RNA, 1701 nt, Artificial Sequence; identical to SEQ ID NO: 101552
  derived and/or modified sequence opt2 from hemagglutinin__InfluenzaA__AHV83894

SEQ ID NO: 103523 - RNA, 1701 nt, Artificial Sequence
  derived and/or modified sequence opt2 from hemagglutinin__InfluenzaA__AHV83895
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggagaccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103524 - RNA, 1701 nt, Artificial Sequence; identical to SEQ ID NO: 101552
  derived and/or modified sequence opt2 from hemagglutinin__InfluenzaA__AHV83896

SEQ ID NO: 103525 - RNA, 1701 nt, Artificial Sequence; identical to SEQ ID NO: 101552
  derived and/or modified sequence opt2 from hemagglutinin__InfluenzaA__AHV83897

SEQ ID NO: 103526 - RNA, 1701 nt, Artificial Sequence
  derived and/or modified sequence opt2 from hemagglutinin__InfluenzaA__AHV83898
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgucaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103527 - RNA, 1701 nt, Artificial Sequence; identical to SEQ ID NO: 101552
  derived and/or modified sequence opt2 from hemagglutinin__InfluenzaA__AHV83899

SEQ ID NO: 103528 - RNA, 1701 nt, Artificial Sequence; identical to SEQ ID NO: 101552
  derived and/or modified sequence opt2 from hemagglutinin__InfluenzaA__AHV83900

SEQ ID NO: 103529 - RNA, 1701 nt, Artificial Sequence; identical to SEQ ID NO: 101552
  derived and/or modified sequence opt2 from hemagglutinin__InfluenzaA__AHV83901

SEQ ID NO: 103530 - RNA, 1701 nt, Artificial Sequence; identical to SEQ ID NO: 101552
  derived and/or modified sequence opt2 from hemagglutinin__InfluenzaA__AHV83902

SEQ ID NO: 103531 - RNA, 1701 nt, Artificial Sequence; identical to SEQ ID NO: 101552
  derived and/or modified sequence opt2 from hemagglutinin__InfluenzaA__AHV83903

SEQ ID NO: 103532 - RNA, 1701 nt, Artificial Sequence; identical to SEQ ID NO: 101552
  derived and/or modified sequence opt2 from hemagglutinin__InfluenzaA__AHV83904

SEQ ID NO: 103533 - RNA, 1701 nt, Artificial Sequence
  derived and/or modified sequence opt2 from hemagglutinin__InfluenzaA__AHV83905
augaaggccauccucgucguccuccucuacacccucaccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103534 - RNA, 1701 nt, Artificial Sequence; identical to SEQ ID NO: 101552
  derived and/or modified sequence opt2 from hemagglutinin__InfluenzaA__AHV83906

SEQ ID NO: 103535 - RNA, 1701 nt, Artificial Sequence; identical to SEQ ID NO: 101552
  derived and/or modified sequence opt2 from hemagglutinin__InfluenzaA__AHV83907

SEQ ID NO: 103536 - RNA, 1701 nt, Artificial Sequence
  derived and/or modified sequence opt2 from hemagglutinin__InfluenzaA__AHV83908
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagccccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaagaagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103537 - RNA, 1701 nt, Artificial Sequence
  derived and/or modified sequence opt2 from hemagglutinin__InfluenzaA__AHV83911
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagccccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103538 - RNA, 1701 nt, Artificial Sequence; identical to SEQ ID NO: 101552
  derived and/or modified sequence opt2 from hemagglutinin__InfluenzaA__AHV83912

SEQ ID NO: 103539 - RNA, 1701 nt, Artificial Sequence; identical to SEQ ID NO: 101552
  derived and/or modified sequence opt2 from hemagglutinin__InfluenzaA__AHV83913

SEQ ID NO: 103540 - RNA, 1701 nt, Artificial Sequence; identical to SEQ ID NO: 101552
  derived and/or modified sequence opt2 from hemagglutinin__InfluenzaA__AHV83915

SEQ ID NO: 103541 - RNA, 1701 nt, Artificial Sequence; identical to SEQ ID NO: 101552
  derived and/or modified sequence opt2 from hemagglutinin__InfluenzaA__AHV83916

SEQ ID NO: 103542 - RNA, 1701 nt, Artificial Sequence; identical to SEQ ID NO: 103537
  derived and/or modified sequence opt2 from hemagglutinin__InfluenzaA__AHV83917

SEQ ID NO: 103543 - RNA, 1701 nt, Artificial Sequence; identical to SEQ ID NO: 102515
  derived and/or modified sequence opt2 from hemagglutinin__InfluenzaA__AHV83919

SEQ ID NO: 103544 - RNA, 1701 nt, Artificial Sequence; identical to SEQ ID NO: 103432
  derived and/or modified sequence opt2 from hemagglutinin__InfluenzaA__AHV83920

SEQ ID NO: 103545 - RNA, 1701 nt, Artificial Sequence; identical to SEQ ID NO: 102533
  derived and/or modified sequence opt2 from hemagglutinin__InfluenzaA__AHV83921

SEQ ID NO: 103546 - RNA, 1701 nt, Artificial Sequence
  derived and/or modified sequence opt2 from hemagglutinin__InfluenzaA__AHV83922
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucucccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103547 - RNA, 1701 nt, Artificial Sequence; identical to SEQ ID NO: 103448
  derived and/or modified sequence opt2 from hemagglutinin__InfluenzaA__AHV83923

SEQ ID NO: 103548 - RNA, 1701 nt, Artificial Sequence; identical to SEQ ID NO: 103432
  derived and/or modified sequence opt2 from hemagglutinin__InfluenzaA__AHV83924

SEQ ID NO: 103549 - RNA, 1701 nt, Artificial Sequence; identical to SEQ ID NO: 103448
  derived and/or modified sequence opt2 from hemagglutinin__InfluenzaA__AHV83925

SEQ ID NO: 103550 - RNA, 1701 nt, Artificial Sequence; identical to SEQ ID NO: 103432
  derived and/or modified sequence opt2 from hemagglutinin__InfluenzaA__AHV83926

SEQ ID NO: 103551 - RNA, 1701 nt, Artificial Sequence; identical to SEQ ID NO: 103537
  derived and/or modified sequence opt2 from hemagglutinin__InfluenzaA__AHV83927

SEQ ID NO: 103552 - RNA, 1701 nt, Artificial Sequence
  derived and/or modified sequence opt2 from hemagglutinin__InfluenzaA__AHV83928
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103553 - RNA, 1701 nt, Artificial Sequence; identical to SEQ ID NO: 103432
  derived and/or modified sequence opt2 from hemagglutinin__InfluenzaA__AHV83929

SEQ ID NO: 103554 - RNA, 1701 nt, Artificial Sequence
  derived and/or modified sequence opt2 from hemagglutinin__InfluenzaA__AHV83930
augaaggccauccucgucauccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103555 - RNA, 1701 nt, Artificial Sequence; identical to SEQ ID NO: 103432
  derived and/or modified sequence opt2 from hemagglutinin__InfluenzaA__AHV83931

SEQ ID NO: 103556 - RNA, 1701 nt, Artificial Sequence; identical to SEQ ID NO: 101552
  derived and/or modified sequence opt2 from hemagglutinin__InfluenzaA__AHV83932

SEQ ID NO: 103557 - RNA, 1701 nt, Artificial Sequence
  derived and/or modified sequence opt2 from hemagglutinin__InfluenzaA__AHV83933
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucaccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgcccucuacuccaccgucgccuccucccucguccucgucgucucccucggcgccaucuccuucuggaugugcuccaacggcucccuccagugccgcaucugcaucuga

SEQ ID NO: 103558 - RNA, 1701 nt, Artificial Sequence; identical to SEQ ID NO: 102515
  derived and/or modified sequence opt2 from hemagglutinin__InfluenzaA__AHV83934

SEQ ID NO: 103559 - RNA, 1701 nt, Artificial Sequence; identical to SEQ ID NO: 101552
  derived and/or modified sequence opt2 from hemagglutinin__InfluenzaA__AHV83935

SEQ ID NO: 103560 - RNA, 1701 nt, Artificial Sequence; identical to SEQ ID NO: 101552
  derived and/or modified sequence opt2 from hemagglutinin__InfluenzaA__AHV83937

SEQ ID NO: 103561 - RNA, 1701 nt, Artificial Sequence
  derived and/or modified sequence opt2 from hemagglutinin__InfluenzaA__AHV83938
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagaucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103562 - RNA, 1701 nt, Artificial Sequence; identical to SEQ ID NO: 103561
  derived and/or modified sequence opt2 from hemagglutinin__InfluenzaA__AHV83939

SEQ ID NO: 103563 - RNA, 1701 nt, Artificial Sequence
  derived and/or modified sequence opt2 from hemagglutinin__InfluenzaA__AHV83940
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuucauggacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgaccgcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103564 - RNA, 1701 nt, Artificial Sequence; identical to SEQ ID NO: 101552
  derived and/or modified sequence opt2 from hemagglutinin__InfluenzaA__AHV83941

SEQ ID NO: 103565 - RNA, 1701 nt, Artificial Sequence
  derived and/or modified sequence opt2 from hemagglutinin__InfluenzaA__AHV83943
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaugugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103566 - RNA, 1701 nt, Artificial Sequence
  derived and/or modified sequence opt2 from hemagglutinin__InfluenzaA__AHV83944
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacgagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103567 - RNA, 1701 nt, Artificial Sequence
  derived and/or modified sequence opt2 from hemagglutinin__InfluenzaA__AHV83945
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccaccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103568 - RNA, 1701 nt, Artificial Sequence
  derived and/or modified sequence opt2 from hemagglutinin__InfluenzaA__AHV83947
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccgucaagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103569 - RNA, 1701 nt, Artificial Sequence; identical to SEQ ID NO: 101552
  derived and/or modified sequence opt2 from hemagglutinin__InfluenzaA__AHV83948

SEQ ID NO: 103570 - RNA, 1701 nt, Artificial Sequence; identical to SEQ ID NO: 101552
  derived and/or modified sequence opt2 from hemagglutinin__InfluenzaA__AHV83949

SEQ ID NO: 103571 - RNA, 1701 nt, Artificial Sequence; identical to SEQ ID NO: 101552
  derived and/or modified sequence opt2 from hemagglutinin__InfluenzaA__AHV83950

SEQ ID NO: 103572 - RNA, 1701 nt, Artificial Sequence
  derived and/or modified sequence opt2 from hemagglutinin__InfluenzaA__AHV83953
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggaccucggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103573 - RNA, 1701 nt, Artificial Sequence; identical to SEQ ID NO: 103404
  derived and/or modified sequence opt2 from hemagglutinin__InfluenzaA__AHV83954

SEQ ID NO: 103574 - RNA, 1701 nt, Artificial Sequence
  derived and/or modified sequence opt2 from hemagglutinin__InfluenzaA__AHV83956
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgagaacuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccaggagaagcagacccgcggcaucuucggcgccaucgccggcuucaucgagaacggcugggagggcaugaaggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103575 - RNA, 1701 nt, Artificial Sequence
  derived and/or modified sequence opt2 from hemagglutinin__InfluenzaA__AHZ13523
augaagaccaucaucgcccucuccuacaucuucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacgagaagugggaccucuucgucgagcgcuccaaggccuucuccaacugcuaccccuacgacguccccgacuacgccucccuccgcucccucgucgccuccuccggcacccucgaguucaucaacgagggcuucaacuggaccggcgucacccaguccggcggcuccuacgccugcaagcgcggcuccgucaacuccuucuucucccgccucaacuggcucuacaaguccgaguccaaguaccccguccucaacgucaccaugcccaacaacggcaaguucgacaagcucuacaucuggggcguccaccaccccuccaccgacaaggagcagaccaaccucuacguccgcgccuccggccgcgucaccgucuccaccaagcgcucccagcagaccgucauccccaacaucggcucccgccccuggguccgcggccucuccucccgcaucuccaucuacuggaccaucgucaagcccggcgacauccuccucaucaacuccaccggcaaccucaucgccccccgcggcuacuucaagauccgcaccggcaaguccuccaucaugcgcuccgacgcccccaucggcaccugcuccuacgagugcaucacccccaacggcuccauccccaacgacaagcccuuccagaacgucaacaagaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagacccgcaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 103576 - RNA, 1698 nt, Artificial Sequence; identical to SEQ ID NO: 95128
  derived and/or modified sequence opt2 from hemagglutinin__InfluenzaA__AHZ13582

SEQ ID NO: 103577 - RNA, 1701 nt, Artificial Sequence
  derived and/or modified sequence opt2 from hemagglutinin__InfluenzaA__AHZ35584
augaagaccaucaucgcccucuccuacauccucugccucaucuucgcccaggagauccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacgacuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103578 - RNA, 1701 nt, Artificial Sequence
  derived and/or modified sequence opt2 from hemagglutinin__InfluenzaA__AHZ35608
augaagaccaucaucgcccucuccuacauccucugccucaucuucgcccaggagauccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacgacuuccagaacaaggagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcaccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103579 - RNA, 1701 nt, Artificial Sequence; identical to SEQ ID NO: 103577
  derived and/or modified sequence opt2 from hemagglutinin__InfluenzaA__AHZ35620

SEQ ID NO: 103580 - RNA, 1701 nt, Artificial Sequence; identical to SEQ ID NO: 103577
  derived and/or modified sequence opt2 from hemagglutinin__InfluenzaA__AHZ35632

SEQ ID NO: 103581 - RNA, 1701 nt, Artificial Sequence; identical to SEQ ID NO: 103577
  derived and/or modified sequence opt2 from hemagglutinin__InfluenzaA__AHZ35644

SEQ ID NO: 103582 - RNA, 1701 nt, Artificial Sequence; identical to SEQ ID NO: 103577
  derived and/or modified sequence opt2 from hemagglutinin__InfluenzaA__AHZ35656

SEQ ID NO: 103583 - RNA, 1701 nt, Artificial Sequence; identical to SEQ ID NO: 103577
  derived and/or modified sequence opt2 from hemagglutinin__InfluenzaA__AHZ35668

SEQ ID NO: 103584 - RNA, 1701 nt, Artificial Sequence; identical to SEQ ID NO: 103578
  derived and/or modified sequence opt2 from hemagglutinin__InfluenzaA__AHZ35680

SEQ ID NO: 103585 - RNA, 1701 nt, Artificial Sequence; identical to SEQ ID NO: 103577
  derived and/or modified sequence opt2 from hemagglutinin__InfluenzaA__AHZ35692

SEQ ID NO: 103586 - RNA, 1701 nt, Artificial Sequence; identical to SEQ ID NO: 103577
  derived and/or modified sequence opt2 from hemagglutinin__InfluenzaA__AHZ35716

SEQ ID NO: 103587 - RNA, 1701 nt, Artificial Sequence; identical to SEQ ID NO: 103578
  derived and/or modified sequence opt2 from hemagglutinin__InfluenzaA__AHZ35728

SEQ ID NO: 103588 - RNA, 1701 nt, Artificial Sequence; identical to SEQ ID NO: 103577
  derived and/or modified sequence opt2 from hemagglutinin__InfluenzaA__AHZ35740

SEQ ID NO: 103589 - RNA, 1701 nt, Artificial Sequence; identical to SEQ ID NO: 103577
  derived and/or modified sequence opt2 from hemagglutinin__InfluenzaA__AHZ35752

SEQ ID NO: 103590 - RNA, 1701 nt, Artificial Sequence; identical to SEQ ID NO: 103577
  derived and/or modified sequence opt2 from hemagglutinin__InfluenzaA__AHZ35764

SEQ ID NO: 103591 - RNA, 1701 nt, Artificial Sequence; identical to SEQ ID NO: 103577
  derived and/or modified sequence opt2 from hemagglutinin__InfluenzaA__AHZ35776

SEQ ID NO: 103592 - RNA, 1701 nt, Artificial Sequence
  derived and/or modified sequence opt2 from hemagglutinin__InfluenzaA__AHZ35823
augaaggccauccucgucguccuccucuacaccuucgccaucgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagauguuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103593 - RNA, 1701 nt, Artificial Sequence; identical to SEQ ID NO: 103592
  derived and/or modified sequence opt2 from hemagglutinin__InfluenzaA__AHZ35834

SEQ ID NO: 103594 - RNA, 1701 nt, Artificial Sequence; identical to SEQ ID NO: 103592
  derived and/or modified sequence opt2 from hemagglutinin__InfluenzaA__AHZ35845

SEQ ID NO: 103595 - RNA, 1701 nt, Artificial Sequence; identical to SEQ ID NO: 103592
  derived and/or modified sequence opt2 from hemagglutinin__InfluenzaA__AHZ35856

SEQ ID NO: 103596 - RNA, 1701 nt, Artificial Sequence
  derived and/or modified sequence opt2 from hemagglutinin__InfluenzaA__AHZ35867
augaagaccaacaucgcccucuccuacauccucugccucgucuccgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccgccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucguccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103597 - RNA, 1701 nt, Artificial Sequence
  derived and/or modified sequence opt2 from hemagglutinin__InfluenzaA__AHZ35879
augaagaccaacaucgcccucuccuacauccucugccucgucuccgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccgccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103598 - RNA, 1701 nt, Artificial Sequence; identical to SEQ ID NO: 103592
  derived and/or modified sequence opt2 from hemagglutinin__InfluenzaA__AHZ35891

SEQ ID NO: 103599 - RNA, 1701 nt, Artificial Sequence; identical to SEQ ID NO: 103592
  derived and/or modified sequence opt2 from hemagglutinin__InfluenzaA__AHZ35902

SEQ ID NO: 103600 - RNA, 1710 nt, Artificial Sequence
  derived and/or modified sequence opt2 from hemagglutinin__InfluenzaA__AHZ35913
augaaggccauccucgucguccuccucuacaccuucgccaucgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagauguuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccucaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagcgcguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103601 - RNA, 1701 nt, Artificial Sequence
  derived and/or modified sequence opt2 from hemagglutinin__InfluenzaA__AHZ35924
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccaggccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccuccaaguacuccaagaaguucaagcccgagaucgccguccgccccaagguccgcgaccaggagggccgcaugaacuacuacuggacccucgucgagcccggcgacaagaucaccuucgaggccaccggcaaccuccucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccacccagucccgcggccucuucggcgccaucgccggcuucaucgagggcggcuggaccggcauggucgacggcugguacggcuaccaccaccagaacgcccagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103602 - RNA, 1701 nt, Artificial Sequence
  derived and/or modified sequence opt2 from hemagglutinin__InfluenzaA__AHZ35935
augaaggccauccucgucguccuccucuacaccuucgccaucgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagauguuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103603 - RNA, 1701 nt, Artificial Sequence; identical to SEQ ID NO: 103597
  derived and/or modified sequence opt2 from hemagglutinin__InfluenzaA__AHZ35946

SEQ ID NO: 103604 - RNA, 1701 nt, Artificial Sequence; identical to SEQ ID NO: 103592
  derived and/or modified sequence opt2 from hemagglutinin__InfluenzaA__AHZ35958

SEQ ID NO: 103605 - RNA, 1701 nt, Artificial Sequence; identical to SEQ ID NO: 103592
  derived and/or modified sequence opt2 from hemagglutinin__InfluenzaA__AHZ35980

SEQ ID NO: 103606 - RNA, 1701 nt, Artificial Sequence; identical to SEQ ID NO: 103592
  derived and/or modified sequence opt2 from hemagglutinin__InfluenzaA__AHZ35991

SEQ ID NO: 103607 - RNA, 1701 nt, Artificial Sequence; identical to SEQ ID NO: 103592
  derived and/or modified sequence opt2 from hemagglutinin__InfluenzaA__AHZ36002

SEQ ID NO: 103608 - RNA, 1701 nt, Artificial Sequence
  derived and/or modified sequence opt2 from hemagglutinin__InfluenzaA__AHZ36013
augaaggccauccucgucguccuccucuacaccuucgccaucgccaacgccgacacccucugcaucggcuaccacgccaacaacuccaccgacaccgucgacaccguccucgagaagaacgucaccgucacccacuccgucaaccuccucgaggacaagcacaaccgcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagauguuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103609 - RNA, 1701 nt, Artificial Sequence
  derived and/or modified sequence opt2 from hemagglutinin__InfluenzaA__AHZ36024
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaccuaccagauccucgccaucuacuccaccgucgccuccucccucguccucgucgucucccucggcgccaucuccuucuggaugugcuccaacggcucccuccagugccgcaucugcaucuga

SEQ ID NO: 103610 - RNA, 1701 nt, Artificial Sequence
  derived and/or modified sequence opt2 from hemagglutinin__InfluenzaA__AHZ36035
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucauccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccgccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103611 - RNA, 1701 nt, Artificial Sequence; identical to SEQ ID NO: 98367
  derived and/or modified sequence opt2 from hemagglutinin__InfluenzaA__AHZ36047

SEQ ID NO: 103612 - RNA, 1701 nt, Artificial Sequence; identical to SEQ ID NO: 103592
  derived and/or modified sequence opt2 from hemagglutinin__InfluenzaA__AHZ36059

SEQ ID NO: 103613 - RNA, 1701 nt, Artificial Sequence; identical to SEQ ID NO: 103609
  derived and/or modified sequence opt2 from hemagglutinin__InfluenzaA__AHZ36070

SEQ ID NO: 103614 - RNA, 1701 nt, Artificial Sequence; identical to SEQ ID NO: 103608
  derived and/or modified sequence opt2 from hemagglutinin__InfluenzaA__AHZ36081

SEQ ID NO: 103615 - RNA, 1701 nt, Artificial Sequence; identical to SEQ ID NO: 103609
  derived and/or modified sequence opt2 from hemagglutinin__InfluenzaA__AHZ36092

SEQ ID NO: 103616 - RNA, 1701 nt, Artificial Sequence; identical to SEQ ID NO: 103592
  derived and/or modified sequence opt2 from hemagglutinin__InfluenzaA__AHZ36103

SEQ ID NO: 103617 - RNA, 1701 nt, Artificial Sequence; identical to SEQ ID NO: 103609
  derived and/or modified sequence opt2 from hemagglutinin__InfluenzaA__AHZ36114

SEQ ID NO: 103618 - RNA, 1701 nt, Artificial Sequence; identical to SEQ ID NO: 103592
  derived and/or modified sequence opt2 from hemagglutinin__InfluenzaA__AHZ36125

SEQ ID NO: 103619 - RNA, 1701 nt, Artificial Sequence; identical to SEQ ID NO: 103592
  derived and/or modified sequence opt2 from hemagglutinin__InfluenzaA__AHZ36136

SEQ ID NO: 103620 - RNA, 1701 nt, Artificial Sequence; identical to SEQ ID NO: 98367
  derived and/or modified sequence opt2 from hemagglutinin__InfluenzaA__AHZ36147

SEQ ID NO: 103621 - RNA, 1701 nt, Artificial Sequence
  derived and/or modified sequence opt2 from hemagglutinin__InfluenzaA__AHZ36158
augaaggccauccucgucguccuccucuacaccuucgccaucgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagauguuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccacccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103622 - RNA, 1701 nt, Artificial Sequence; identical to SEQ ID NO: 103592
  derived and/or modified sequence opt2 from hemagglutinin__InfluenzaA__AHZ36169

SEQ ID NO: 103623 - RNA, 1701 nt, Artificial Sequence
  derived and/or modified sequence opt2 from hemagglutinin__InfluenzaA__AHZ36180
augaaggccauccucgucguccuccucuacaccuucgccaucgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagauguuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccauccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103624 - RNA, 1701 nt, Artificial Sequence; identical to SEQ ID NO: 103597
  derived and/or modified sequence opt2 from hemagglutinin__InfluenzaA__AHZ36191

SEQ ID NO: 103625 - RNA, 1701 nt, Artificial Sequence; identical to SEQ ID NO: 98367
  derived and/or modified sequence opt2 from hemagglutinin__InfluenzaA__AHZ36203

SEQ ID NO: 103626 - RNA, 1701 nt, Artificial Sequence; identical to SEQ ID NO: 103592
  derived and/or modified sequence opt2 from hemagglutinin__InfluenzaA__AHZ36215

SEQ ID NO: 103627 - RNA, 1701 nt, Artificial Sequence; identical to SEQ ID NO: 98367
  derived and/or modified sequence opt2 from hemagglutinin__InfluenzaA__AHZ36226

SEQ ID NO: 103628 - RNA, 1701 nt, Artificial Sequence; identical to SEQ ID NO: 103592
  derived and/or modified sequence opt2 from hemagglutinin__InfluenzaA__AHZ36238

SEQ ID NO: 103629 - RNA, 1701 nt, Artificial Sequence; identical to SEQ ID NO: 103592
  derived and/or modified sequence opt2 from hemagglutinin__InfluenzaA__AHZ36249

SEQ ID NO: 103630 - RNA, 1701 nt, Artificial Sequence
  derived and/or modified sequence opt2 from hemagglutinin__InfluenzaA__AHZ36260
augaaggccauccucgucguccuccucuacaccuucgccaucgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuucuccuccgacaacggcaccugcuaccccggcgacuucaucaacuacgaggagcuccgcgagcagcucuccuccgucuccuccuucgagcgcuucgagauguuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103631 - RNA, 1701 nt, Artificial Sequence; identical to SEQ ID NO: 103577
  derived and/or modified sequence opt2 from hemagglutinin__InfluenzaA__AHZ36271

SEQ ID NO: 103632 - RNA, 1701 nt, Artificial Sequence; identical to SEQ ID NO: 103592
  derived and/or modified sequence opt2 from hemagglutinin__InfluenzaA__AHZ36283

SEQ ID NO: 103633 - RNA, 1701 nt, Artificial Sequence; identical to SEQ ID NO: 103577
  derived and/or modified sequence opt2 from hemagglutinin__InfluenzaA__AHZ36294

SEQ ID NO: 103634 - RNA, 1701 nt, Artificial Sequence
  derived and/or modified sequence opt2 from hemagglutinin__InfluenzaA__AHZ36306
augaaggccauccucgucguccuccucuacaccuucgccaucgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagauguuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaagaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103635 - RNA, 1701 nt, Artificial Sequence; identical to SEQ ID NO: 103592
  derived and/or modified sequence opt2 from hemagglutinin__InfluenzaA__AHZ36317

SEQ ID NO: 103636 - RNA, 1701 nt, Artificial Sequence; identical to SEQ ID NO: 103592
  derived and/or modified sequence opt2 from hemagglutinin__InfluenzaA__AHZ36328

SEQ ID NO: 103637 - RNA, 1701 nt, Artificial Sequence
  derived and/or modified sequence opt2 from hemagglutinin__InfluenzaA__AHZ36339
augaaggccauccucgucguccuccucuacaccuucgccaucgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagauguuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccgucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagcgccgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103638 - RNA, 1701 nt, Artificial Sequence
  derived and/or modified sequence opt2 from hemagglutinin__InfluenzaA__AHZ36362
augaaggccauccucgucguccuccucuacaccuucgccaucgccaacgccgacacccucugcaucggcuaccacgccaacaacuccaccgacaccgucgacaccguccucgagaagaacgucaccgucacccacuccaucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagauguuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccgucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagcgccgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103639 - RNA, 1701 nt, Artificial Sequence
  derived and/or modified sequence opt2 from hemagglutinin__InfluenzaA__AHZ36385
augaagaccaucaucgcccucuccuacauccucugccucaucuucgcccaggagauccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacgacuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuucaagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103640 - RNA, 1701 nt, Artificial Sequence
  derived and/or modified sequence opt2 from hemagglutinin__InfluenzaA__AHZ36397
augaagaccaucaucgcccucuccuacauccucugccucaucuucgcccaggagauccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacgacuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuucaagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103641 - RNA, 1701 nt, Artificial Sequence; identical to SEQ ID NO: 103577
  derived and/or modified sequence opt2 from hemagglutinin__InfluenzaA__AHZ36409

SEQ ID NO: 103642 - RNA, 1701 nt, Artificial Sequence; identical to SEQ ID NO: 103578
  derived and/or modified sequence opt2 from hemagglutinin__InfluenzaA__AHZ36433

SEQ ID NO: 103643 - RNA, 1701 nt, Artificial Sequence
  derived and/or modified sequence opt2 from hemagglutinin__InfluenzaA__AHZ36445
augaagaccaucaucgcccucuccuacauccucugccucaucuucgcccaggagauccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacgacuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacgacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103644 - RNA, 1701 nt, Artificial Sequence; identical to SEQ ID NO: 103577
  derived and/or modified sequence opt2 from hemagglutinin__InfluenzaA__AHZ36457

SEQ ID NO: 103645 - RNA, 1701 nt, Artificial Sequence; identical to SEQ ID NO: 103577
  derived and/or modified sequence opt2 from hemagglutinin__InfluenzaA__AHZ36469

SEQ ID NO: 103646 - RNA, 1701 nt, Artificial Sequence
  derived and/or modified sequence opt2 from hemagglutinin__InfluenzaA__AHZ36481
augaagaccaucaucgcccucuccuacauccucugccucaucuucgcccaggagauccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacgacuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103647 - RNA, 1701 nt, Artificial Sequence; identical to SEQ ID NO: 103578
  derived and/or modified sequence opt2 from hemagglutinin__InfluenzaA__AHZ36493

SEQ ID NO: 103648 - RNA, 1701 nt, Artificial Sequence; identical to SEQ ID NO: 103578
  derived and/or modified sequence opt2 from hemagglutinin__InfluenzaA__AHZ36505

SEQ ID NO: 103649 - RNA, 1701 nt, Artificial Sequence; identical to SEQ ID NO: 103578
  derived and/or modified sequence opt2 from hemagglutinin__InfluenzaA__AHZ36517

SEQ ID NO: 103650 - RNA, 1701 nt, Artificial Sequence
  derived and/or modified sequence opt2 from hemagglutinin__InfluenzaA__AHZ36529
augaagaccaucaucgcccucuccuacauccucugccucaucuucgcccaggagauccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacgacuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccuccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103651 - RNA, 1701 nt, Artificial Sequence; identical to SEQ ID NO: 103577
  derived and/or modified sequence opt2 from hemagglutinin__InfluenzaA__AHZ36541

SEQ ID NO: 103652 - RNA, 1701 nt, Artificial Sequence
  derived and/or modified sequence opt2 from hemagglutinin__InfluenzaA__AHZ36553
augaagaccaucaucgcccucuccuacauccucugccucaucuucgcccaggagauccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacgacuuccagaacaaggagugggaccucuucgucgagcgcuccaaggcccacuccaacugcuaccccuacgacguccccgacuacgccucccuccgcucccucgucgccuccuccggcacccucgaguucaagaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcaccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103653 - RNA, 1701 nt, Artificial Sequence; identical to SEQ ID NO: 103577
  derived and/or modified sequence opt2 from hemagglutinin__InfluenzaA__AHZ36565

SEQ ID NO: 103654 - RNA, 1701 nt, Artificial Sequence; identical to SEQ ID NO: 103577
  derived and/or modified sequence opt2 from hemagglutinin__InfluenzaA__AHZ36577

SEQ ID NO: 103655 - RNA, 1701 nt, Artificial Sequence; identical to SEQ ID NO: 103577
  derived and/or modified sequence opt2 from hemagglutinin__InfluenzaA__AHZ36589

SEQ ID NO: 103656 - RNA, 1701 nt, Artificial Sequence; identical to SEQ ID NO: 103652
  derived and/or modified sequence opt2 from hemagglutinin__InfluenzaA__AHZ36601

SEQ ID NO: 103657 - RNA, 1701 nt, Artificial Sequence
  derived and/or modified sequence opt2 from hemagglutinin__InfluenzaA__AHZ36613
augaagaccaucaucgcccucuccuacauccucugccucaucuucgcccaggagauccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacgacuuccagaacaaggagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcaccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaccuccugcuuccuccucugcgucgcccuccucggcuucaucaugugggccugccagaagggcaacauccgcugcaacaucugcaucuga

SEQ ID NO: 103658 - RNA, 1701 nt, Artificial Sequence; identical to SEQ ID NO: 103577
  derived and/or modified sequence opt2 from hemagglutinin__InfluenzaA__AHZ36625

SEQ ID NO: 103659 - RNA, 1701 nt, Artificial Sequence; identical to SEQ ID NO: 103578
  derived and/or modified sequence opt2 from hemagglutinin__InfluenzaA__AHZ36637

SEQ ID NO: 103660 - RNA, 1701 nt, Artificial Sequence; identical to SEQ ID NO: 103578
  derived and/or modified sequence opt2 from hemagglutinin__InfluenzaA__AHZ36649

SEQ ID NO: 103661 - RNA, 1701 nt, Artificial Sequence; identical to SEQ ID NO: 101506
  derived and/or modified sequence opt2 from hemagglutinin__InfluenzaA__AHZ36661

SEQ ID NO: 103662 - RNA, 1701 nt, Artificial Sequence; identical to SEQ ID NO: 101506
  derived and/or modified sequence opt2 from hemagglutinin__InfluenzaA__AHZ36673

SEQ ID NO: 103663 - RNA, 1701 nt, Artificial Sequence
  derived and/or modified sequence opt2 from hemagglutinin__InfluenzaA__AHZ36685
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagcgcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103664 - RNA, 1683 nt, Artificial Sequence; identical to SEQ ID NO: 101500
  derived and/or modified sequence opt2 from hemagglutinin__InfluenzaA__AHZ39698

SEQ ID NO: 103665 - RNA, 1683 nt, Artificial Sequence
  derived and/or modified sequence opt2 from hemagglutinin__InfluenzaA__AHZ39722
augaacacccagauccucgucuucgcccucaucgccaucauccccaccaacgccgacaagaucugccucggccaccacgccgucuccaacggcaccaaggucaacacccucaccgagcgcggcgucgaggucgucaacgccaccgagaccgucgagcgcaccaacaucccccgcaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggaggccaugggcuucaccuacuccggcauccgcaccgacggcgccaccuccgccugccgccgcuccggcuccuccuucuacgccgagaugaaguggcuccucuccaacaccgacgacgccgccuucccccagaugaccaaguccuacaagaacacccgcaagucccccgcccucaucgucuggggcauccaccacuccgucuccaccgccgagcagaccaagcucuacggcuccggcaacaagcucgucaccgucggcuccuccaacuaccagcaguccuucguccccucccccggcgcccgcccccaggucaacggccucuccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacuccggcggcaccaucaucuccaaccuccccuuccagaacaucgacucccgcgccgucggcaagugcccccgcuacgucaagcagcgcucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucgaccagaucaccggcaagcucaaccgccucaucgagaagaccaaccagcaguucgagcucaucgacaacgaguucaacgaggucgagaagcagaucggcaacgucaucaacuggacccgcgacuccaucaccgaggucugguccuacaacgccgagcuccucgucgccauggagaaccagcacaccaucgaccucgccgacuccgagauggacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgucaugggccucgucuucaucugcgucaagaacggcaacaugcgcugcaccaucugcaucuga

SEQ ID NO: 103666 - RNA, 1683 nt, Artificial Sequence; identical to SEQ ID NO: 103665
  derived and/or modified sequence opt2 from hemagglutinin__InfluenzaA__AHZ39734

SEQ ID NO: 103667 - RNA, 1683 nt, Artificial Sequence
  derived and/or modified sequence opt2 from hemagglutinin__InfluenzaA__AHZ39746
augaacacccagauccucgucuucgcccucaucgccaucauccccaccaacgccgacaagaucugccucggccaccacgccgucuccaacggcaccaaggucaacacccucaccgagcgcggcgucgaggucgucaacgccaccgagaccgucgagcgcaccaacaucccccgcaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggaggccaugggcuucaccuacuccggcauccgcaccaacggcgccaccuccgccugccgccgcuccggcuccuccuucuacgccgagaugaaguggcuccucuccaacaccgacaacgccgccuucccccagaugaccaaguccuacaagaacacccgcaagucccccgcccucaucgucuggggcauccaccacuccgucuccaccgccgagcagaccaagcucuacggcuccggcaacaagcucgucaccgucggcuccuccaacuaccagcaguccuucguccccucccccggcgagcgcccccaggucaacggccucuccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacuccggcggcaccaucaucuccaaccuccccuuccagaacaucgacucccgcgccgucggcaagugcccccgcuacgucaagcagcgcucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucgaccagaucaccggcaagcucaaccgccucaucgagaagaccaaccagcaguucgagcucaucgacaacgaguucaacgaggucgagaagcagaucggcaacgucaucaacuggacccgcgacuccaucaccgaggucugguccuacaacgccgagcuccucgucgccauggagaaccagcacaccaucgaccucgccgacuccgagauggacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgucaugggccucgucuucaucugcgucaagaacggcaacaugcgcugcaccaucugcaucuga

SEQ ID NO: 103668 - RNA, 1683 nt, Artificial Sequence; identical to SEQ ID NO: 103665
  derived and/or modified sequence opt2 from hemagglutinin__InfluenzaA__AHZ39758

SEQ ID NO: 103669 - RNA, 1683 nt, Artificial Sequence; identical to SEQ ID NO: 103665
  derived and/or modified sequence opt2 from hemagglutinin__InfluenzaA__AHZ39770

SEQ ID NO: 103670 - RNA, 1683 nt, Artificial Sequence; identical to SEQ ID NO: 103665
  derived and/or modified sequence opt2 from hemagglutinin__InfluenzaA__AHZ39782

SEQ ID NO: 103671 - RNA, 1701 nt, Artificial Sequence; identical to SEQ ID NO: 101395
  derived and/or modified sequence opt2 from hemagglutinin__InfluenzaA__AHZ39794

SEQ ID NO: 103672 - RNA, 1701 nt, Artificial Sequence; identical to SEQ ID NO: 101509
  derived and/or modified sequence opt2 from hemagglutinin__InfluenzaA__AHZ39806

SEQ ID NO: 103673 - RNA, 1701 nt, Artificial Sequence
  derived and/or modified sequence opt2 from hemagglutinin__InfluenzaA__AHZ39818
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaccuuccucuacgcccaggccgccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcucaucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 103674 - RNA, 1701 nt, Artificial Sequence; identical to SEQ ID NO: 101395
  derived and/or modified sequence opt2 from hemagglutinin__InfluenzaA__AHZ39841

SEQ ID NO: 103675 - RNA, 1701 nt, Artificial Sequence; identical to SEQ ID NO: 101415
  derived and/or modified sequence opt2 from hemagglutinin__InfluenzaA__AHZ39853

SEQ ID NO: 103676 - RNA, 1701 nt, Artificial Sequence; identical to SEQ ID NO: 101395
  derived and/or modified sequence opt2 from hemagglutinin__InfluenzaA__AHZ39865

SEQ ID NO: 103677 - RNA, 1701 nt, Artificial Sequence
  derived and/or modified sequence opt2 from hemagglutinin__InfluenzaA__AHZ39877
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaccuccugcuuccuccucugcgucgcccuccucggcuucaucaugugggccugccagaagggcaacauccgcugcaacaucugcaucuga

SEQ ID NO: 103678 - RNA, 1701 nt, Artificial Sequence; identical to SEQ ID NO: 101415
  derived and/or modified sequence opt2 from hemagglutinin__InfluenzaA__AHZ39889

SEQ ID NO: 103679 - RNA, 1701 nt, Artificial Sequence; identical to SEQ ID NO: 101396
  derived and/or modified sequence opt2 from hemagglutinin__InfluenzaA__AHZ39913

SEQ ID NO: 103680 - RNA, 1701 nt, Artificial Sequence
  derived and/or modified sequence opt2 from hemagglutinin__InfluenzaA__AHZ39925
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103681 - RNA, 1701 nt, Artificial Sequence; identical to SEQ ID NO: 101395
  derived and/or modified sequence opt2 from hemagglutinin__InfluenzaA__AHZ39937

SEQ ID NO: 103682 - RNA, 1701 nt, Artificial Sequence; identical to SEQ ID NO: 101395
  derived and/or modified sequence opt2 from hemagglutinin__InfluenzaA__AHZ39949

SEQ ID NO: 103683 - RNA, 1701 nt, Artificial Sequence; identical to SEQ ID NO: 101395
  derived and/or modified sequence opt2 from hemagglutinin__InfluenzaA__AHZ39961

SEQ ID NO: 103684 - RNA, 1701 nt, Artificial Sequence; identical to SEQ ID NO: 101395
  derived and/or modified sequence opt2 from hemagglutinin__InfluenzaA__AHZ39973

SEQ ID NO: 103685 - RNA, 1701 nt, Artificial Sequence
  derived and/or modified sequence opt2 from hemagglutinin__InfluenzaA__AHZ39985
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgccuccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaccuccugcuuccuccucugcgucgcccuccucggcuucaucaugugggccugccagaagggcaacauccgcugcaacaucugcaucuga

SEQ ID NO: 103686 - RNA, 1701 nt, Artificial Sequence; identical to SEQ ID NO: 101395
  derived and/or modified sequence opt2 from hemagglutinin__InfluenzaA__AHZ39997

SEQ ID NO: 103687 - RNA, 1701 nt, Artificial Sequence
  derived and/or modified sequence opt2 from hemagglutinin__InfluenzaA__AHZ40009
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaucuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcaaguccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103688 - RNA, 1701 nt, Artificial Sequence; identical to SEQ ID NO: 101395
  derived and/or modified sequence opt2 from hemagglutinin__InfluenzaA__AHZ40021

SEQ ID NO: 103689 - RNA, 1701 nt, Artificial Sequence; identical to SEQ ID NO: 101370
  derived and/or modified sequence opt2 from hemagglutinin__InfluenzaA__AHZ40033

SEQ ID NO: 103690 - RNA, 1701 nt, Artificial Sequence; identical to SEQ ID NO: 101395
  derived and/or modified sequence opt2 from hemagglutinin__InfluenzaA__AHZ40045

SEQ ID NO: 103691 - RNA, 1701 nt, Artificial Sequence; identical to SEQ ID NO: 101395
  derived and/or modified sequence opt2 from hemagglutinin__InfluenzaA__AHZ40060

SEQ ID NO: 103692 - RNA, 1701 nt, Artificial Sequence; identical to SEQ ID NO: 101395
  derived and/or modified sequence opt2 from hemagglutinin__InfluenzaA__AHZ40072

SEQ ID NO: 103693 - RNA, 1701 nt, Artificial Sequence; identical to SEQ ID NO: 101395
  derived and/or modified sequence opt2 from hemagglutinin__InfluenzaA__AHZ40084

SEQ ID NO: 103694 - RNA, 1701 nt, Artificial Sequence; identical to SEQ ID NO: 101395
  derived and/or modified sequence opt2 from hemagglutinin__InfluenzaA__AHZ40096

SEQ ID NO: 103695 - RNA, 1701 nt, Artificial Sequence; identical to SEQ ID NO: 101396
  derived and/or modified sequence opt2 from hemagglutinin__InfluenzaA__AHZ40108

SEQ ID NO: 103696 - RNA, 1701 nt, Artificial Sequence; identical to SEQ ID NO: 101509
  derived and/or modified sequence opt2 from hemagglutinin__InfluenzaA__AHZ40120

SEQ ID NO: 103697 - RNA, 1701 nt, Artificial Sequence
  derived and/or modified sequence opt2 from hemagglutinin__InfluenzaA__AHZ40130
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaagaacuggauccucuggaucuccuucgccaucuccugcuuccuccucugcgucgcccuccucggcuucaucaugugggccugccagaagggcaacauccgcugcaacaucugcaucuga

SEQ ID NO: 103698 - RNA, 1701 nt, Artificial Sequence
  derived and/or modified sequence opt2 from hemagglutinin__InfluenzaA__AHZ40142
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccaggacaagaagugggaccucuucgucgagcgcuccaaggccuacuccaacugcuaccccuacgacguccccgacuacgccucccuccgcucccucgucgccuccuccggcacccucgaguucaacaacgagaacuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgaccgccccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103699 - RNA, 1701 nt, Artificial Sequence
  derived and/or modified sequence opt2 from hemagglutinin__InfluenzaA__AHZ40154
augaagaccaucaucgcccucuccuacauccucugccucggcuucgcccaggagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgcggcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacaugcuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcaacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103700 - RNA, 1701 nt, Artificial Sequence
  derived and/or modified sequence opt2 from hemagglutinin__InfluenzaA__AHZ40166
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucaucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggccgcugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103701 - RNA, 1701 nt, Artificial Sequence; identical to SEQ ID NO: 101395
  derived and/or modified sequence opt2 from hemagglutinin__InfluenzaA__AHZ40177

SEQ ID NO: 103702 - RNA, 1701 nt, Artificial Sequence; identical to SEQ ID NO: 101395
  derived and/or modified sequence opt2 from hemagglutinin__InfluenzaA__AHZ40189

SEQ ID NO: 103703 - RNA, 1701 nt, Artificial Sequence; identical to SEQ ID NO: 101395
  derived and/or modified sequence opt2 from hemagglutinin__InfluenzaA__AHZ40201

SEQ ID NO: 103704 - RNA, 1701 nt, Artificial Sequence; identical to SEQ ID NO: 101380
  derived and/or modified sequence opt2 from hemagglutinin__InfluenzaA__AHZ40213

SEQ ID NO: 103705 - RNA, 1701 nt, Artificial Sequence; identical to SEQ ID NO: 101347
  derived and/or modified sequence opt2 from hemagglutinin__InfluenzaA__AHZ40225

SEQ ID NO: 103706 - RNA, 1701 nt, Artificial Sequence
  derived and/or modified sequence opt2 from hemagglutinin__InfluenzaA__AHZ40237
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaccgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103707 - RNA, 1701 nt, Artificial Sequence; identical to SEQ ID NO: 101403
  derived and/or modified sequence opt2 from hemagglutinin__InfluenzaA__AHZ40249

SEQ ID NO: 103708 - RNA, 1701 nt, Artificial Sequence; identical to SEQ ID NO: 101370
  derived and/or modified sequence opt2 from hemagglutinin__InfluenzaA__AHZ40261

SEQ ID NO: 103709 - RNA, 1701 nt, Artificial Sequence; identical to SEQ ID NO: 101509
  derived and/or modified sequence opt2 from hemagglutinin__InfluenzaA__AHZ40273

SEQ ID NO: 103710 - RNA, 1701 nt, Artificial Sequence
  derived and/or modified sequence opt2 from hemagglutinin__InfluenzaA__AHZ40285
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccgacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaguccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccaguccggcaaguccuccaucaugcgcuccgacacccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103711 - RNA, 1701 nt, Artificial Sequence; identical to SEQ ID NO: 101506
  derived and/or modified sequence opt2 from hemagglutinin__InfluenzaA__AHZ40297

SEQ ID NO: 103712 - RNA, 1701 nt, Artificial Sequence
  derived and/or modified sequence opt2 from hemagglutinin__InfluenzaA__AHZ40309
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 103713 - RNA, 1701 nt, Artificial Sequence; identical to SEQ ID NO: 101395
  derived and/or modified sequence opt2 from hemagglutinin__InfluenzaA__AHZ40321

SEQ ID NO: 103714 - RNA, 1701 nt, Artificial Sequence; identical to SEQ ID NO: 101395
  derived and/or modified sequence opt2 from hemagglutinin__InfluenzaA__AHZ40333

SEQ ID NO: 103715 - RNA, 1701 nt, Artificial Sequence
  derived and/or modified sequence opt2 from hemagglutinin__InfluenzaA__AHZ40345
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccuccgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103716 - RNA, 1701 nt, Artificial Sequence; identical to SEQ ID NO: 101396
  derived and/or modified sequence opt2 from hemagglutinin__InfluenzaA__AHZ40357

SEQ ID NO: 103717 - RNA, 1701 nt, Artificial Sequence
  derived and/or modified sequence opt2 from hemagglutinin__InfluenzaA__AHZ40369
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggccgcuccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103718 - RNA, 1701 nt, Artificial Sequence; identical to SEQ ID NO: 101506
  derived and/or modified sequence opt2 from hemagglutinin__InfluenzaA__AHZ40381

SEQ ID NO: 103719 - RNA, 1701 nt, Artificial Sequence; identical to SEQ ID NO: 101395
  derived and/or modified sequence opt2 from hemagglutinin__InfluenzaA__AHZ40393

SEQ ID NO: 103720 - RNA, 1701 nt, Artificial Sequence; identical to SEQ ID NO: 101395
  derived and/or modified sequence opt2 from hemagglutinin__InfluenzaA__AHZ40405

SEQ ID NO: 103721 - RNA, 1701 nt, Artificial Sequence; identical to SEQ ID NO: 101395
  derived and/or modified sequence opt2 from hemagglutinin__InfluenzaA__AHZ40417

SEQ ID NO: 103722 - RNA, 1701 nt, Artificial Sequence
  derived and/or modified sequence opt2 from hemagglutinin__InfluenzaA__AHZ40429
augaagaccaucaucgcccucuccuacauccucugccucgucuucgcccaggagcuccccggcaacgacgacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaagaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103723 - RNA, 1701 nt, Artificial Sequence; identical to SEQ ID NO: 101395
  derived and/or modified sequence opt2 from hemagglutinin__InfluenzaA__AHZ40441

SEQ ID NO: 103724 - RNA, 1701 nt, Artificial Sequence; identical to SEQ ID NO: 101538
  derived and/or modified sequence opt2 from hemagglutinin__InfluenzaA__AHZ40453

SEQ ID NO: 103725 - RNA, 1701 nt, Artificial Sequence
  derived and/or modified sequence opt2 from hemagglutinin__InfluenzaA__AHZ40465
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacaugcccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcgcuucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103726 - RNA, 1701 nt, Artificial Sequence; identical to SEQ ID NO: 101396
  derived and/or modified sequence opt2 from hemagglutinin__InfluenzaA__AHZ40477

SEQ ID NO: 103727 - RNA, 1701 nt, Artificial Sequence; identical to SEQ ID NO: 101572
  derived and/or modified sequence opt2 from hemagglutinin__InfluenzaA__AHZ40489

SEQ ID NO: 103728 - RNA, 1701 nt, Artificial Sequence; identical to SEQ ID NO: 101395
  derived and/or modified sequence opt2 from hemagglutinin__InfluenzaA__AHZ40500

SEQ ID NO: 103729 - RNA, 1701 nt, Artificial Sequence; identical to SEQ ID NO: 101395
  derived and/or modified sequence opt2 from hemagglutinin__InfluenzaA__AHZ40512

SEQ ID NO: 103730 - RNA, 1701 nt, Artificial Sequence
  derived and/or modified sequence opt2 from hemagglutinin__InfluenzaA__AHZ40524
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagcgccagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103731 - RNA, 1701 nt, Artificial Sequence; identical to SEQ ID NO: 103282
  derived and/or modified sequence opt2 from hemagglutinin__InfluenzaA__AHZ40536

SEQ ID NO: 103732 - RNA, 1701 nt, Artificial Sequence; identical to SEQ ID NO: 101395
  derived and/or modified sequence opt2 from hemagglutinin__InfluenzaA__AHZ40548

SEQ ID NO: 103733 - RNA, 1701 nt, Artificial Sequence; identical to SEQ ID NO: 101370
  derived and/or modified sequence opt2 from hemagglutinin__InfluenzaA__AHZ40572

SEQ ID NO: 103734 - RNA, 1701 nt, Artificial Sequence; identical to SEQ ID NO: 101370
  derived and/or modified sequence opt2 from hemagglutinin__InfluenzaA__AHZ40583

SEQ ID NO: 103735 - RNA, 1701 nt, Artificial Sequence
  derived and/or modified sequence opt2 from hemagglutinin__InfluenzaA__AHZ40595
augaaggccauccucgucgucaugcucuacaccuucgccaccgccaacgccgacacccucugcaucggcuaccacgccaacaacuccaccgacaccgucgacaccguccucgagaagaacgucaccgucacccacuccgucaaccuccucgaggacaagcacgacggcaagcucugcaagcuccgcggcgucgccccccuccaccucggcaagugcaacaucgccggcuggauccucggcaaccccgagugcgagucccucuccaccgccuccuccugguccuacaucgucgagaccuccggcuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaucuccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccaugaagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 103736 - RNA, 1701 nt, Artificial Sequence
  derived and/or modified sequence opt2 from hemagglutinin__InfluenzaA__AHZ40606
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103737 - RNA, 1701 nt, Artificial Sequence; identical to SEQ ID NO: 101395
  derived and/or modified sequence opt2 from hemagglutinin__InfluenzaA__AHZ40618

SEQ ID NO: 103738 - RNA, 1701 nt, Artificial Sequence; identical to SEQ ID NO: 101434
  derived and/or modified sequence opt2 from hemagglutinin__InfluenzaA__AHZ40626

SEQ ID NO: 103739 - RNA, 1701 nt, Artificial Sequence; identical to SEQ ID NO: 101395
  derived and/or modified sequence opt2 from hemagglutinin__InfluenzaA__AHZ40638

SEQ ID NO: 103740 - RNA, 1701 nt, Artificial Sequence; identical to SEQ ID NO: 101370
  derived and/or modified sequence opt2 from hemagglutinin__InfluenzaA__AHZ40650

SEQ ID NO: 103741 - RNA, 1701 nt, Artificial Sequence
  derived and/or modified sequence opt2 from hemagglutinin__InfluenzaA__AHZ40662
augaagaccaucaucgcccucuccuacauccucugccucgucuucgcccaggagcuccccggcaacgacgacuccaccgccacccucugccucggccaccacgccguccccaacggcaccaucgucaagaccaucaccaacgaccgcaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccauccccaacaacgagcaguucgacaagcucuacaucuggggcguccaccaccccggcaccgacaaggaccagaucuuccucuacgcccaggccuccggccgcaucaccgucuccaccaagcgcucccagcagaccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103742 - RNA, 1701 nt, Artificial Sequence; identical to SEQ ID NO: 101415
  derived and/or modified sequence opt2 from hemagglutinin__InfluenzaA__AHZ40674

SEQ ID NO: 103743 - RNA, 1701 nt, Artificial Sequence; identical to SEQ ID NO: 101395
  derived and/or modified sequence opt2 from hemagglutinin__InfluenzaA__AHZ40686

SEQ ID NO: 103744 - RNA, 1701 nt, Artificial Sequence; identical to SEQ ID NO: 101380
  derived and/or modified sequence opt2 from hemagglutinin__InfluenzaA__AHZ40698

SEQ ID NO: 103745 - RNA, 1701 nt, Artificial Sequence; identical to SEQ ID NO: 101380
  derived and/or modified sequence opt2 from hemagglutinin__InfluenzaA__AHZ40710

SEQ ID NO: 103746 - RNA, 1701 nt, Artificial Sequence; identical to SEQ ID NO: 101506
  derived and/or modified sequence opt2 from hemagglutinin__InfluenzaA__AHZ40722

SEQ ID NO: 103747 - RNA, 1701 nt, Artificial Sequence; identical to SEQ ID NO: 101403
  derived and/or modified sequence opt2 from hemagglutinin__InfluenzaA__AHZ40734

SEQ ID NO: 103748 - RNA, 1701 nt, Artificial Sequence; identical to SEQ ID NO: 101506
  derived and/or modified sequence opt2 from hemagglutinin__InfluenzaA__AHZ40746

SEQ ID NO: 103749 - RNA, 1701 nt, Artificial Sequence; identical to SEQ ID NO: 103699
  derived and/or modified sequence opt2 from hemagglutinin__InfluenzaA__AHZ40758

SEQ ID NO: 103750 - RNA, 1701 nt, Artificial Sequence; identical to SEQ ID NO: 94179
  derived and/or modified sequence opt2 from hemagglutinin__InfluenzaA__AHZ40782

SEQ ID NO: 103751 - RNA, 1701 nt, Artificial Sequence; identical to SEQ ID NO: 94179
  derived and/or modified sequence opt2 from hemagglutinin__InfluenzaA__AHZ40793

SEQ ID NO: 103752 - RNA, 1701 nt, Artificial Sequence; identical to SEQ ID NO: 94179
  derived and/or modified sequence opt2 from hemagglutinin__InfluenzaA__AHZ40804

SEQ ID NO: 103753 - RNA, 1701 nt, Artificial Sequence
  derived and/or modified sequence opt2 from hemagglutinin__InfluenzaA__AHZ40815
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagacccccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcgaccgcgagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103754 - RNA, 1701 nt, Artificial Sequence
  derived and/or modified sequence opt2 from hemagglutinin__InfluenzaA__AHZ40826
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagacccccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcaguccaucuaccagaacgccgacgccuacgucuucgucggcuccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103755 - RNA, 1701 nt, Artificial Sequence
  derived and/or modified sequence opt2 from hemagglutinin__InfluenzaA__AHZ40848
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagacccccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaaggagggcaacuccuaccccaagcucuccaaguccuacaucaacgacaagggcaaggagguccucguccucuggggcauccaccaccccuccaccuccgccgagcagcagucccucuaccagaacgccgacgccuacgucuucgucggcuccucccgcuacuccaagaaguucaagcccgagaucgccgcccgccccaagguccgcggccaggccggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103756 - RNA, 1701 nt, Artificial Sequence
  derived and/or modified sequence opt2 from hemagglutinin__InfluenzaA__AHZ40881
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagacccccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgagcagcagucccucuaccagaacgccgacgccuacgucuucgucggcuccucccgcuacuccaagaaguucaagcccgagaucgccgcccgccccaagguccgcggccaggccggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103757 - RNA, 1701 nt, Artificial Sequence; identical to SEQ ID NO: 103756
  derived and/or modified sequence opt2 from hemagglutinin__InfluenzaA__AHZ40892

SEQ ID NO: 103758 - RNA, 1701 nt, Artificial Sequence; identical to SEQ ID NO: 103755
  derived and/or modified sequence opt2 from hemagglutinin__InfluenzaA__AHZ40914

SEQ ID NO: 103759 - RNA, 1701 nt, Artificial Sequence; identical to SEQ ID NO: 103756
  derived and/or modified sequence opt2 from hemagglutinin__InfluenzaA__AHZ40925

SEQ ID NO: 103760 - RNA, 1701 nt, Artificial Sequence
  derived and/or modified sequence opt2 from hemagglutinin__InfluenzaA__AHZ40936
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagacccccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgagcagcagucccucuaccagaacgccgacgccuacgucuucgucggcuccucccgcuacuccaagaaguucaagcccgagaucgccgcccgccccaagguccgcgaccaggccggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103761 - RNA, 1701 nt, Artificial Sequence; identical to SEQ ID NO: 103755
  derived and/or modified sequence opt2 from hemagglutinin__InfluenzaA__AHZ40947

SEQ ID NO: 103762 - RNA, 1701 nt, Artificial Sequence; identical to SEQ ID NO: 103756
  derived and/or modified sequence opt2 from hemagglutinin__InfluenzaA__AHZ40958

SEQ ID NO: 103763 - RNA, 1701 nt, Artificial Sequence; identical to SEQ ID NO: 103760
  derived and/or modified sequence opt2 from hemagglutinin__InfluenzaA__AHZ40969

SEQ ID NO: 103764 - RNA, 1701 nt, Artificial Sequence; identical to SEQ ID NO: 103760
  derived and/or modified sequence opt2 from hemagglutinin__InfluenzaA__AHZ40980

SEQ ID NO: 103765 - RNA, 1701 nt, Artificial Sequence; identical to SEQ ID NO: 103760
  derived and/or modified sequence opt2 from hemagglutinin__InfluenzaA__AHZ40991

SEQ ID NO: 103766 - RNA, 1701 nt, Artificial Sequence; identical to SEQ ID NO: 103760
  derived and/or modified sequence opt2 from hemagglutinin__InfluenzaA__AHZ41002

SEQ ID NO: 103767 - RNA, 1701 nt, Artificial Sequence; identical to SEQ ID NO: 103760
  derived and/or modified sequence opt2 from hemagglutinin__InfluenzaA__AHZ41013

SEQ ID NO: 103768 - RNA, 1701 nt, Artificial Sequence; identical to SEQ ID NO: 103756
  derived and/or modified sequence opt2 from hemagglutinin__InfluenzaA__AHZ41024

SEQ ID NO: 103769 - RNA, 1701 nt, Artificial Sequence; identical to SEQ ID NO: 103756
  derived and/or modified sequence opt2 from hemagglutinin__InfluenzaA__AHZ41035

SEQ ID NO: 103770 - RNA, 1701 nt, Artificial Sequence; identical to SEQ ID NO: 103756
  derived and/or modified sequence opt2 from hemagglutinin__InfluenzaA__AHZ41046

SEQ ID NO: 103771 - RNA, 1701 nt, Artificial Sequence; identical to SEQ ID NO: 103756
  derived and/or modified sequence opt2 from hemagglutinin__InfluenzaA__AHZ41057

SEQ ID NO: 103772 - RNA, 1701 nt, Artificial Sequence; identical to SEQ ID NO: 103756
  derived and/or modified sequence opt2 from hemagglutinin__InfluenzaA__AHZ41068

SEQ ID NO: 103773 - RNA, 1701 nt, Artificial Sequence; identical to SEQ ID NO: 103760
  derived and/or modified sequence opt2 from hemagglutinin__InfluenzaA__AHZ41079

SEQ ID NO: 103774 - RNA, 1701 nt, Artificial Sequence; identical to SEQ ID NO: 103756
  derived and/or modified sequence opt2 from hemagglutinin__InfluenzaA__AHZ41090

SEQ ID NO: 103775 - RNA, 1701 nt, Artificial Sequence; identical to SEQ ID NO: 103760
  derived and/or modified sequence opt2 from hemagglutinin__InfluenzaA__AHZ41101

SEQ ID NO: 103776 - RNA, 1701 nt, Artificial Sequence; identical to SEQ ID NO: 103756
  derived and/or modified sequence opt2 from hemagglutinin__InfluenzaA__AHZ41112

SEQ ID NO: 103777 - RNA, 1701 nt, Artificial Sequence; identical to SEQ ID NO: 103756
  derived and/or modified sequence opt2 from hemagglutinin__InfluenzaA__AHZ41123

SEQ ID NO: 103778 - RNA, 1701 nt, Artificial Sequence; identical to SEQ ID NO: 103756
  derived and/or modified sequence opt2 from hemagglutinin__InfluenzaA__AHZ41134

SEQ ID NO: 103779 - RNA, 1701 nt, Artificial Sequence; identical to SEQ ID NO: 103756
  derived and/or modified sequence opt2 from hemagglutinin__InfluenzaA__AHZ41145

SEQ ID NO: 103780 - RNA, 1701 nt, Artificial Sequence; identical to SEQ ID NO: 103756
  derived and/or modified sequence opt2 from hemagglutinin__InfluenzaA__AHZ41156

SEQ ID NO: 103781 - RNA, 1701 nt, Artificial Sequence; identical to SEQ ID NO: 103756
  derived and/or modified sequence opt2 from hemagglutinin__InfluenzaA__AHZ41167

SEQ ID NO: 103782 - RNA, 1701 nt, Artificial Sequence; identical to SEQ ID NO: 103756
  derived and/or modified sequence opt2 from hemagglutinin__InfluenzaA__AHZ41178

SEQ ID NO: 103783 - RNA, 1701 nt, Artificial Sequence; identical to SEQ ID NO: 103756
  derived and/or modified sequence opt2 from hemagglutinin__InfluenzaA__AHZ41189

SEQ ID NO: 103784 - RNA, 1701 nt, Artificial Sequence; identical to SEQ ID NO: 103755
  derived and/or modified sequence opt2 from hemagglutinin__InfluenzaA__AHZ41246

SEQ ID NO: 103785 - RNA, 1701 nt, Artificial Sequence; identical to SEQ ID NO: 103760
  derived and/or modified sequence opt2 from hemagglutinin__InfluenzaA__AHZ41263

SEQ ID NO: 103786 - RNA, 1701 nt, Artificial Sequence; identical to SEQ ID NO: 103756
  derived and/or modified sequence opt2 from hemagglutinin__InfluenzaA__AHZ41281

SEQ ID NO: 103787 - RNA, 1701 nt, Artificial Sequence; identical to SEQ ID NO: 103756
  derived and/or modified sequence opt2 from hemagglutinin__InfluenzaA__AHZ41292

SEQ ID NO: 103788 - RNA, 1701 nt, Artificial Sequence; identical to SEQ ID NO: 103755
  derived and/or modified sequence opt2 from hemagglutinin__InfluenzaA__AHZ41303

SEQ ID NO: 103789 - RNA, 1701 nt, Artificial Sequence; identical to SEQ ID NO: 103755
  derived and/or modified sequence opt2 from hemagglutinin__InfluenzaA__AHZ41314

SEQ ID NO: 103790 - RNA, 1701 nt, Artificial Sequence; identical to SEQ ID NO: 103755
  derived and/or modified sequence opt2 from hemagglutinin__InfluenzaA__AHZ41325

SEQ ID NO: 103791 - RNA, 1701 nt, Artificial Sequence; identical to SEQ ID NO: 103755
  derived and/or modified sequence opt2 from hemagglutinin__InfluenzaA__AHZ41336

SEQ ID NO: 103792 - RNA, 1701 nt, Artificial Sequence; identical to SEQ ID NO: 103755
  derived and/or modified sequence opt2 from hemagglutinin__InfluenzaA__AHZ41347

SEQ ID NO: 103793 - RNA, 1701 nt, Artificial Sequence; identical to SEQ ID NO: 103756
  derived and/or modified sequence opt2 from hemagglutinin__InfluenzaA__AHZ41358

SEQ ID NO: 103794 - RNA, 1701 nt, Artificial Sequence; identical to SEQ ID NO: 103756
  derived and/or modified sequence opt2 from hemagglutinin__InfluenzaA__AHZ41366

SEQ ID NO: 103795 - RNA, 1701 nt, Artificial Sequence; identical to SEQ ID NO: 103760
  derived and/or modified sequence opt2 from hemagglutinin__InfluenzaA__AHZ41377

SEQ ID NO: 103796 - RNA, 1701 nt, Artificial Sequence; identical to SEQ ID NO: 103756
  derived and/or modified sequence opt2 from hemagglutinin__InfluenzaA__AHZ41388

SEQ ID NO: 103797 - RNA, 1701 nt, Artificial Sequence; identical to SEQ ID NO: 103760
  derived and/or modified sequence opt2 from hemagglutinin__InfluenzaA__AHZ41410

SEQ ID NO: 103798 - RNA, 1701 nt, Artificial Sequence; identical to SEQ ID NO: 103756
  derived and/or modified sequence opt2 from hemagglutinin__InfluenzaA__AHZ41432

SEQ ID NO: 103799 - RNA, 1701 nt, Artificial Sequence
  derived and/or modified sequence opt2 from hemagglutinin__InfluenzaA__AHZ41441
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagacccccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaaggagggcaacuccuaccccaagcucuccaaguccuacaucaacgacaagggcaaggagguccucguccucuggggcauccaccaccccuccaccuccgccgagcagcagucccucuaccagaacgccgacgccuacgucuucgucggcuccucccgcuacuccaagaaguucaagcccgagaucgccgcccgccccaagguccgcgaccaggccggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103800 - RNA, 1701 nt, Artificial Sequence; identical to SEQ ID NO: 103755
  derived and/or modified sequence opt2 from hemagglutinin__InfluenzaA__AHZ41452

SEQ ID NO: 103801 - RNA, 1701 nt, Artificial Sequence
  derived and/or modified sequence opt2 from hemagglutinin__InfluenzaA__AHZ41463
augaaggccauccucgucguccuccucuacaccuucgccaccgccaacgccgacacccucugcaucggcuaccacgccaacaacuccaccgacaccgucuacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagacccccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgagcagcagucccucuaccagaacgccgacgccuacgucuucgucggcuccucccgcuacuccaagaaguucaagcccgagaucgccgcccgccccaagguccgcggccaggccggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103802 - RNA, 1701 nt, Artificial Sequence; identical to SEQ ID NO: 103755
  derived and/or modified sequence opt2 from hemagglutinin__InfluenzaA__AHZ41473

SEQ ID NO: 103803 - RNA, 1701 nt, Artificial Sequence; identical to SEQ ID NO: 103755
  derived and/or modified sequence opt2 from hemagglutinin__InfluenzaA__AHZ41484

SEQ ID NO: 103804 - RNA, 1701 nt, Artificial Sequence; identical to SEQ ID NO: 103760
  derived and/or modified sequence opt2 from hemagglutinin__InfluenzaA__AHZ41495

SEQ ID NO: 103805 - RNA, 1701 nt, Artificial Sequence; identical to SEQ ID NO: 103755
  derived and/or modified sequence opt2 from hemagglutinin__InfluenzaA__AHZ41506

SEQ ID NO: 103806 - RNA, 1701 nt, Artificial Sequence
  derived and/or modified sequence opt2 from hemagglutinin__InfluenzaA__AHZ41517
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagacccccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccgaguccuacaucaacgacaagggcaaggagguccucguccucuggggcauccaccaccccuccaccuccgccgagcagcagucccucuaccagaacgccgacgccuacgucuucgucggcuccucccgcuacuccaagaaguucaagcccgagaucgccgcccgccccaagguccgcggccaggccggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103807 - RNA, 1701 nt, Artificial Sequence
  derived and/or modified sequence opt2 from hemagglutinin__InfluenzaA__AHZ41528
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagacccccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccgaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccgcccgccccaagguccgcggccaggccggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103808 - RNA, 1701 nt, Artificial Sequence; identical to SEQ ID NO: 103760
  derived and/or modified sequence opt2 from hemagglutinin__InfluenzaA__AHZ41539

SEQ ID NO: 103809 - RNA, 1701 nt, Artificial Sequence; identical to SEQ ID NO: 103755
  derived and/or modified sequence opt2 from hemagglutinin__InfluenzaA__AHZ41550

SEQ ID NO: 103810 - RNA, 1701 nt, Artificial Sequence; identical to SEQ ID NO: 103756
  derived and/or modified sequence opt2 from hemagglutinin__InfluenzaA__AHZ41561

SEQ ID NO: 103811 - RNA, 1701 nt, Artificial Sequence
  derived and/or modified sequence opt2 from hemagglutinin__InfluenzaA__AHZ41572
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagacccccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgagcagcagucccucuaccagaacgccgacgccuacgucuucgucggcuccucccgcuacuccaagaaguucaagcccgagaucgccgcccgccccaagguccgcggccaggccggccgcaugaacuacuacuggacccucgucgagcccggcgacgagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103812 - RNA, 1701 nt, Artificial Sequence; identical to SEQ ID NO: 103760
  derived and/or modified sequence opt2 from hemagglutinin__InfluenzaA__AHZ41583

SEQ ID NO: 103813 - RNA, 1701 nt, Artificial Sequence; identical to SEQ ID NO: 103755
  derived and/or modified sequence opt2 from hemagglutinin__InfluenzaA__AHZ41594

SEQ ID NO: 103814 - RNA, 1701 nt, Artificial Sequence
  derived and/or modified sequence opt2 from hemagglutinin__InfluenzaA__AHZ41605
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagacccccuccuccgacaacggcaccugcuaccccggcgacuucaucgacuacgaggagcuccgcgagcagcucuccuccgucuccuccuucgagcgcuucgagaucuuccccaacaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgagcagcagucccucuaccagaacgccgacgccuacgucuucgucggcuccucccgcuacuccaagaaguucaagcccgagaucgccgcccgccccaaggucaugggccaggccggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103815 - RNA, 1701 nt, Artificial Sequence; identical to SEQ ID NO: 103755
  derived and/or modified sequence opt2 from hemagglutinin__InfluenzaA__AHZ41616

SEQ ID NO: 103816 - RNA, 1701 nt, Artificial Sequence; identical to SEQ ID NO: 103760
  derived and/or modified sequence opt2 from hemagglutinin__InfluenzaA__AHZ41627

SEQ ID NO: 103817 - RNA, 1701 nt, Artificial Sequence; identical to SEQ ID NO: 103760
  derived and/or modified sequence opt2 from hemagglutinin__InfluenzaA__AHZ41638

SEQ ID NO: 103818 - RNA, 1701 nt, Artificial Sequence; identical to SEQ ID NO: 103756
  derived and/or modified sequence opt2 from hemagglutinin__InfluenzaA__AHZ41649

SEQ ID NO: 103819 - RNA, 1701 nt, Artificial Sequence; identical to SEQ ID NO: 103756
  derived and/or modified sequence opt2 from hemagglutinin__InfluenzaA__AHZ41660

SEQ ID NO: 103820 - RNA, 1701 nt, Artificial Sequence; identical to SEQ ID NO: 103760
  derived and/or modified sequence opt2 from hemagglutinin__InfluenzaA__AHZ41671

SEQ ID NO: 103821 - RNA, 1701 nt, Artificial Sequence; identical to SEQ ID NO: 103760
  derived and/or modified sequence opt2 from hemagglutinin__InfluenzaA__AHZ41682

SEQ ID NO: 103822 - RNA, 1701 nt, Artificial Sequence; identical to SEQ ID NO: 103760
  derived and/or modified sequence opt2 from hemagglutinin__InfluenzaA__AHZ41693

SEQ ID NO: 103823 - RNA, 1701 nt, Artificial Sequence; identical to SEQ ID NO: 103760
  derived and/or modified sequence opt2 from hemagglutinin__InfluenzaA__AHZ41704

SEQ ID NO: 103824 - RNA, 1701 nt, Artificial Sequence; identical to SEQ ID NO: 103760
  derived and/or modified sequence opt2 from hemagglutinin__InfluenzaA__AHZ41715

SEQ ID NO: 103825 - RNA, 1701 nt, Artificial Sequence; identical to SEQ ID NO: 103760
  derived and/or modified sequence opt2 from hemagglutinin__InfluenzaA__AHZ41726

SEQ ID NO: 103826 - RNA, 1701 nt, Artificial Sequence; identical to SEQ ID NO: 103760
  derived and/or modified sequence opt2 from hemagglutinin__InfluenzaA__AHZ41737

SEQ ID NO: 103827 - RNA, 1701 nt, Artificial Sequence; identical to SEQ ID NO: 103760
  derived and/or modified sequence opt2 from hemagglutinin__InfluenzaA__AHZ41748

SEQ ID NO: 103828 - RNA, 1701 nt, Artificial Sequence; identical to SEQ ID NO: 103760
  derived and/or modified sequence opt2 from hemagglutinin__InfluenzaA__AHZ41759

SEQ ID NO: 103829 - RNA, 1701 nt, Artificial Sequence; identical to SEQ ID NO: 101587
  derived and/or modified sequence opt2 from hemagglutinin__InfluenzaA__AHZ42561

SEQ ID NO: 103830 - RNA, 1701 nt, Artificial Sequence
  derived and/or modified sequence opt2 from hemagglutinin__InfluenzaA__AHZ42572
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagauggacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103831 - RNA, 1701 nt, Artificial Sequence; identical to SEQ ID NO: 103298
  derived and/or modified sequence opt2 from hemagglutinin__InfluenzaA__AHZ42584

SEQ ID NO: 103832 - RNA, 1701 nt, Artificial Sequence; identical to SEQ ID NO: 101395
  derived and/or modified sequence opt2 from hemagglutinin__InfluenzaA__AHZ42596

SEQ ID NO: 103833 - RNA, 1701 nt, Artificial Sequence; identical to SEQ ID NO: 101572
  derived and/or modified sequence opt2 from hemagglutinin__InfluenzaA__AHZ42608

SEQ ID NO: 103834 - RNA, 1701 nt, Artificial Sequence; identical to SEQ ID NO: 101395
  derived and/or modified sequence opt2 from hemagglutinin__InfluenzaA__AHZ42619

SEQ ID NO: 103835 - RNA, 1701 nt, Artificial Sequence
  derived and/or modified sequence opt2 from hemagglutinin__InfluenzaA__AHZ42631
augaagaccaucaucgcccucuccuacauccucugccucgucuucgcccagaagcuccccggcaacuacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103836 - RNA, 1701 nt, Artificial Sequence
  derived and/or modified sequence opt2 from hemagglutinin__InfluenzaA__AHZ42643
augaaggccauccucgucgucaugcucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccggcuccgacaacggcaccugcuaccccggcgacuucaucgacuacgaggagcuccgcgagcagcucuccuccgucuccuccuucgagcgcuucgagaucuuccccaaggccuccuccuggcccaaccacgacuccaacaagggcgucaccgccgccugcccccacgccggcgccaagggcuucuacaagaaccucaucuggcucgucaagaagggcaacuccuaccccaagcucuccaucuccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 103837 - RNA, 1701 nt, Artificial Sequence; identical to SEQ ID NO: 101395
  derived and/or modified sequence opt2 from hemagglutinin__InfluenzaA__AHZ42654

SEQ ID NO: 103838 - RNA, 1701 nt, Artificial Sequence; identical to SEQ ID NO: 101370
  derived and/or modified sequence opt2 from hemagglutinin__InfluenzaA__AHZ42666

SEQ ID NO: 103839 - RNA, 1701 nt, Artificial Sequence; identical to SEQ ID NO: 101370
  derived and/or modified sequence opt2 from hemagglutinin__InfluenzaA__AHZ42678

SEQ ID NO: 103840 - RNA, 1701 nt, Artificial Sequence
  derived and/or modified sequence opt2 from hemagglutinin__InfluenzaA__AHZ42690
augaaggccauccucgucguccuccucuacaccuacgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccaccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucaucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103841 - RNA, 1701 nt, Artificial Sequence; identical to SEQ ID NO: 101395
  derived and/or modified sequence opt2 from hemagglutinin__InfluenzaA__AHZ42701

SEQ ID NO: 103842 - RNA, 1701 nt, Artificial Sequence; identical to SEQ ID NO: 101370
  derived and/or modified sequence opt2 from hemagglutinin__InfluenzaA__AHZ42713

SEQ ID NO: 103843 - RNA, 1701 nt, Artificial Sequence
  derived and/or modified sequence opt2 from hemagglutinin__InfluenzaA__AHZ42725
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcaacggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103844 - RNA, 1701 nt, Artificial Sequence
  derived and/or modified sequence opt2 from hemagglutinin__InfluenzaA__AHZ42737
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucaucgagcccggcgacaagaucaccuucgaggccaccggcaaccucgucgucccccgcuacgccuucgccauggagcgcaacgccgaguccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103845 - RNA, 1701 nt, Artificial Sequence; identical to SEQ ID NO: 101395
  derived and/or modified sequence opt2 from hemagglutinin__InfluenzaA__AHZ42748

SEQ ID NO: 103846 - RNA, 1701 nt, Artificial Sequence; identical to SEQ ID NO: 101415
  derived and/or modified sequence opt2 from hemagglutinin__InfluenzaA__AHZ42760

SEQ ID NO: 103847 - RNA, 1701 nt, Artificial Sequence
  derived and/or modified sequence opt2 from hemagglutinin__InfluenzaA__AHZ42772
augaagaccaucaucgcccucuccuacauccucugccucgucuucgcccaggagcuccccggcaacgacgacuccaccgccacccucugccucggccaccacgccguccccaacggcaccaucgucaagaccaucaccaacgaccgcaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcagaccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaaggaggucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103848 - RNA, 1701 nt, Artificial Sequence; identical to SEQ ID NO: 101395
  derived and/or modified sequence opt2 from hemagglutinin__InfluenzaA__AHZ42784

SEQ ID NO: 103849 - RNA, 1701 nt, Artificial Sequence; identical to SEQ ID NO: 101370
  derived and/or modified sequence opt2 from hemagglutinin__InfluenzaA__AHZ42796

SEQ ID NO: 103850 - RNA, 1701 nt, Artificial Sequence; identical to SEQ ID NO: 101370
  derived and/or modified sequence opt2 from hemagglutinin__InfluenzaA__AHZ42808

SEQ ID NO: 103851 - RNA, 1701 nt, Artificial Sequence; identical to SEQ ID NO: 103844
  derived and/or modified sequence opt2 from hemagglutinin__InfluenzaA__AHZ42820

SEQ ID NO: 103852 - RNA, 1701 nt, Artificial Sequence; identical to SEQ ID NO: 101979
  derived and/or modified sequence opt2 from hemagglutinin__InfluenzaA__AHZ42831

SEQ ID NO: 103853 - RNA, 1701 nt, Artificial Sequence
  derived and/or modified sequence opt2 from hemagglutinin__InfluenzaA__AHZ42843
augaagaccaucaucgcccucuccuacauccucugccucgucuucgcccagaagcuccccggcaacgacaacuccaccgccacccucugccucggccaccacgccguccccaacggcaccauggucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103854 - RNA, 1701 nt, Artificial Sequence
  derived and/or modified sequence opt2 from hemagglutinin__InfluenzaA__AHZ42855
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacaugaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103855 - RNA, 1701 nt, Artificial Sequence
  derived and/or modified sequence opt2 from hemagglutinin__InfluenzaA__AHZ42867
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccgaguacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103856 - RNA, 1701 nt, Artificial Sequence; identical to SEQ ID NO: 101370
  derived and/or modified sequence opt2 from hemagglutinin__InfluenzaA__AHZ42879

SEQ ID NO: 103857 - RNA, 1701 nt, Artificial Sequence
  derived and/or modified sequence opt2 from hemagglutinin__InfluenzaA__AHZ42891
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccuccugcuaccccuacgacguccccgacuacgccucccuccgcucccucgucgccuccuccggcacccucgaguucaacaacgaguccuucaacugggccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103858 - RNA, 1701 nt, Artificial Sequence
  derived and/or modified sequence opt2 from hemagglutinin__InfluenzaA__AHZ42903
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103859 - RNA, 1701 nt, Artificial Sequence; identical to SEQ ID NO: 101347
  derived and/or modified sequence opt2 from hemagglutinin__InfluenzaA__AHZ42915

SEQ ID NO: 103860 - RNA, 1683 nt, Artificial Sequence; identical to SEQ ID NO: 101500
  derived and/or modified sequence opt2 from hemagglutinin__InfluenzaA__AHZ59747

SEQ ID NO: 103861 - RNA, 1683 nt, Artificial Sequence
  derived and/or modified sequence opt2 from hemagglutinin__InfluenzaA__AHZ59759
augaacacccagauccucgucuucgcccucaucgccaucauccccaccaacgccgacaagaucugccucggccaccacgccgucuccaacggcaccaaggucaacacccucaccgagcgcggcgucgaggucgucaacgccaccgagaccgucgagcgcaccaacaucccccgcaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggaggccaugggcuucaccuacuccggcauccgcaccaacggcgccaccuccgccugccgccgcuccggcuccuccuucuacgccgagaugaaguggcuccucuccaacaccgacaacgccgccuucccccagaugaccaaguccuacaagaacacccgcaagucccccgcccucaucgucuggggcauccaccacuccgucuccaccgccgagcagaccaagcucuacggcuccggcaacaagcucgucaccgucggcuccuccaacuaccagcaguccuucguccccucccccggcgcccgcccccaggucaacggccucuccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacuccggcggcaccaucaucuccaaccuccccuuccagaacaucgacucccgcgccgucggcaagugcccccgcuacgucaagcagcgcucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucgaccagaucaccggcaagcucaaccgccucaucgagaagaccaaccagcaguucgagcucaucgacaacgaguucaacgaggucgagaagcagaucggcaacgucaucaacuggacccgcgacuccaucaccgaggucugguccuacaacgccgagcuccucgucgccauggagaaccagcacaccaucgaccucgccgacuccgagauggacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaagucccgcgaggaggccaugcagaaccgcauccagaucgaccccgucaagcucuccuccggcuacaaggacgucauccucugguucuccuucggcgccuccugcuucauccuccucgccaucgucaugggccucgucuucaucugcgucaagaacggcaacaugcgcugcaccaucugcaucuga

SEQ ID NO: 103862 - RNA, 1683 nt, Artificial Sequence
  derived and/or modified sequence opt2 from hemagglutinin__InfluenzaA__AHZ59771
augaacacccagauccucgucuucgcccucaucgccaucauccccaccaacgccgacaagaucugccucggccaccacgccgucuccaacggcaccaaggucaacacccucaccgagcgcggcgucgaggucgucaacgccaccgagaccgucgagcgcaccaacaucccccgcaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggaggccaugggcuucaccuacuccggcauccgcaccaacggcgccaccuccgccugccgccgcuccggcuccuccuucuacgccgagaugaaguggcuccucuccaacaccgacaacgccgccuucccccagaugaccaaguccuacaagaacacccgcaagucccccgcccucaucgucuggggcauccaccacuccgucuccaccgccgagcagaccaagcucuacggcuccggcaacaagcucgucaccgucggcuccuccaacuaccagcaguccuucguccccucccccggcgcccgcccccaggucaacggccaguccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacuccggcggcaccaucaucuccaaccuccccuuccagaacaucgacucccgcgccgucggcaagugcccccgcuacgucaagcagcgcucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucgaccagaucaccggcaagcucaaccgccucaucgagaagaccaaccagcaguucgagcucaucgacaacgaguucaacgaggucgagaagcagaucggcaacgucaucaacuggacccgcgacuccaucaccgaggucugguccuacaacgccgagcuccucgucgccauggagaaccagcacaccaucgaccucgccgacuccgagauggacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgucaugggccucgucuucaucugcgucaagaacggcaacaugcgcugcaccaucugcaucuga

SEQ ID NO: 103863 - RNA, 1683 nt, Artificial Sequence
  derived and/or modified sequence opt2 from hemagglutinin__InfluenzaA__AHZ59795
augaacacccagauccucgucuucgcccucaucgccaucauccccaccaacgccgacaagaucugccucggccaccacgccgucuccaacggcaccaaggucaacacccucaccgagcgcggcgucgaggucgucaacgccaccgagaccgucgagcgcaccaacaucccccgcaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggaggccaugggcuucaccuacuccggcauccgcaccaacggcaccaccuccgccugccgccgcuccggcuccuccuucuacgccgagaugaaguggcuccucuccaacaccgacaacgccgccuucccccagaugaccaaguccuacaagaacacccgcaagucccccgcccucaucgucuggggcauccaccacuccgucuccaccgccgagcagaccaagcucuacggcuccggcaacaagcucgucaccgucggcuccuccaacuaccagcaguccuucguccccucccccggcgcccgcccccaggucaacggccucuccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacuccggcggcaccaucaucuccaaccuccccuuccagaacaucgacucccgcgccgucggcaagugcccccgcuacgucaagcagcgcucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucgaccagaucaccggcaagcucaaccgccucaucgagaagaccaaccagcaguucgagcucaucgacaacgaguucaacgaggucgagaagcagaucggcaacgucaucaacuggacccgcgacuccaucaccgaggucugguccuacaacgccgagcuccucgucgccauggagaaccagcacaccaucgaccucgccgacuccgagauggacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgucaugggccucgucuucaucugcgucaagaacggcaacaugcgcugcaccaucugcaucuga

SEQ ID NO: 103864 - RNA, 1683 nt, Artificial Sequence; identical to SEQ ID NO: 103863
  derived and/or modified sequence opt2 from hemagglutinin__InfluenzaA__AHZ59807

SEQ ID NO: 103865 - RNA, 1683 nt, Artificial Sequence; identical to SEQ ID NO: 103863
  derived and/or modified sequence opt2 from hemagglutinin__InfluenzaA__AHZ59819

SEQ ID NO: 103866 - RNA, 1683 nt, Artificial Sequence; identical to SEQ ID NO: 101500
  derived and/or modified sequence opt2 from hemagglutinin__InfluenzaA__AHZ59831

SEQ ID NO: 103867 - RNA, 1683 nt, Artificial Sequence; identical to SEQ ID NO: 101500
  derived and/or modified sequence opt2 from hemagglutinin__InfluenzaA__AHZ59843

SEQ ID NO: 103868 - RNA, 1683 nt, Artificial Sequence; identical to SEQ ID NO: 101500
  derived and/or modified sequence opt2 from hemagglutinin__InfluenzaA__AHZ59855

SEQ ID NO: 103869 - RNA, 1683 nt, Artificial Sequence; identical to SEQ ID NO: 103862
  derived and/or modified sequence opt2 from hemagglutinin__InfluenzaA__AHZ59867

SEQ ID NO: 103870 - RNA, 1683 nt, Artificial Sequence; identical to SEQ ID NO: 101500
  derived and/or modified sequence opt2 from hemagglutinin__InfluenzaA__AHZ59879

SEQ ID NO: 103871 - RNA, 1683 nt, Artificial Sequence; identical to SEQ ID NO: 103862
  derived and/or modified sequence opt2 from hemagglutinin__InfluenzaA__AHZ59915

SEQ ID NO: 103872 - RNA, 1683 nt, Artificial Sequence; identical to SEQ ID NO: 101500
  derived and/or modified sequence opt2 from hemagglutinin__InfluenzaA__AHZ59927

SEQ ID NO: 103873 - RNA, 1683 nt, Artificial Sequence; identical to SEQ ID NO: 103862
  derived and/or modified sequence opt2 from hemagglutinin__InfluenzaA__AHZ59939

SEQ ID NO: 103874 - RNA, 1683 nt, Artificial Sequence; identical to SEQ ID NO: 101500
  derived and/or modified sequence opt2 from hemagglutinin__InfluenzaA__AHZ59951

SEQ ID NO: 103875 - RNA, 1683 nt, Artificial Sequence; identical to SEQ ID NO: 101500
  derived and/or modified sequence opt2 from hemagglutinin__InfluenzaA__AHZ59963

SEQ ID NO: 103876 - RNA, 1683 nt, Artificial Sequence; identical to SEQ ID NO: 101500
  derived and/or modified sequence opt2 from hemagglutinin__InfluenzaA__AHZ59988

SEQ ID NO: 103877 - RNA, 1683 nt, Artificial Sequence; identical to SEQ ID NO: 101500
  derived and/or modified sequence opt2 from hemagglutinin__InfluenzaA__AHZ60000

SEQ ID NO: 103878 - RNA, 1683 nt, Artificial Sequence; identical to SEQ ID NO: 101500
  derived and/or modified sequence opt2 from hemagglutinin__InfluenzaA__AHZ60012

SEQ ID NO: 103879 - RNA, 1683 nt, Artificial Sequence; identical to SEQ ID NO: 101500
  derived and/or modified sequence opt2 from hemagglutinin__InfluenzaA__AHZ60024

SEQ ID NO: 103880 - RNA, 1683 nt, Artificial Sequence; identical to SEQ ID NO: 103863
  derived and/or modified sequence opt2 from hemagglutinin__InfluenzaA__AHZ60036

SEQ ID NO: 103881 - RNA, 1683 nt, Artificial Sequence; identical to SEQ ID NO: 103863
  derived and/or modified sequence opt2 from hemagglutinin__InfluenzaA__AHZ60048

SEQ ID NO: 103882 - RNA, 1683 nt, Artificial Sequence; identical to SEQ ID NO: 103863
  derived and/or modified sequence opt2 from hemagglutinin__InfluenzaA__AHZ60060

SEQ ID NO: 103883 - RNA, 1683 nt, Artificial Sequence; identical to SEQ ID NO: 103863
  derived and/or modified sequence opt2 from hemagglutinin__InfluenzaA__AHZ60072

SEQ ID NO: 103884 - RNA, 1683 nt, Artificial Sequence; identical to SEQ ID NO: 103863
  derived and/or modified sequence opt2 from hemagglutinin__InfluenzaA__AHZ60084

SEQ ID NO: 103885 - RNA, 1683 nt, Artificial Sequence
  derived and/or modified sequence opt2 from hemagglutinin__InfluenzaA__AHZ60096
augaacacccagauccucgucuucgcccucaucgccaucauccccaccaacgccgacaagaucugccucggccaccacgccgucuccaacggcaccaaggucaacacccucaccgagcgcggcgucgaggucgucaacgccaccgagaccgucgagcgcaccaacaucccccgcaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggaggccaugggcuucaccuacuccggcauccgcaccaacggcgccaccuccgccugccgccgcuccggcuccuccuucuacgccgagaugaaguggcuccucuccaacaccgacgacgccgccuucccccagaugaccaaguccuacaagaacacccgcaagucccccgcccucaucgucuggggcauccaccacuccgucuccaccgccgagcagaccaagcucuacggcuccggcaacaagcucgucaccgucggcuccuccaacuaccagcaguccuucguccccucccccggcgcccgcccccaggucaacggccucuccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacuccggcggcaccaucaucuccaaccuccccuuccagaacaucgacucccgcgccgucggcaagugcccccgcuacgucaagcagcgcucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucgaccagaucaccggcaagcucaaccgccucaucgagaagaccaaccagcaguucgagcucaucgacaacgaguucaacgaggucgagaagcagaucggcaacgucaucaacuggacccgcgacuccaucaccgaggucugguccuacaacgccgagcuccucgucgccauggagaaccagcacaccaucgaccucgccgacuccgagauggacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgucaugggccucgucuucaucugcgucaagaacggcaacaugcgcugcaccaucugcaucuga

SEQ ID NO: 103886 - RNA, 1701 nt, Artificial Sequence
  derived and/or modified sequence opt2 from hemagglutinin__InfluenzaA__AIC64889
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaacauccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaaggagaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcuccucccgcuacuccaagaaguucaagcccgagaucgccauccgccccaagguccgcggccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103887 - RNA, 1701 nt, Artificial Sequence; identical to SEQ ID NO: 101552
  derived and/or modified sequence opt2 from hemagglutinin__InfluenzaA__AIC73738

SEQ ID NO: 103888 - RNA, 1701 nt, Artificial Sequence
  derived and/or modified sequence opt2 from hemagglutinin__InfluenzaA__AIC73739
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgccacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103889 - RNA, 1701 nt, Artificial Sequence
  derived and/or modified sequence opt2 from hemagglutinin__InfluenzaA__AIC73740
augaaggccauccucgucguccuccucuacaccuucaccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccacccccccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucgaccgcgagaagaucgacggcguccgccucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103890 - RNA, 1701 nt, Artificial Sequence
  derived and/or modified sequence opt2 from hemagglutinin__InfluenzaA__AIC73741
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccacugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccaccgcugcgacaacgccugcaucggcuccauccgcaacggcaccuacgaccacaacgucuaccgcgacgaggcccucaacaaccgcuuccagauccgcggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103891 - RNA, 1701 nt, Artificial Sequence
  derived and/or modified sequence opt2 from hemagglutinin__InfluenzaA__AIC73742
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcuccgccaguccuacaucaacgacaagggcaaggagguccucguccucuggggcauccaccaccccuccaccaccaccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaaccgcaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103892 - RNA, 1701 nt, Artificial Sequence; identical to SEQ ID NO: 103891
  derived and/or modified sequence opt2 from hemagglutinin__InfluenzaA__AIC73743

SEQ ID NO: 103893 - RNA, 1701 nt, Artificial Sequence
  derived and/or modified sequence opt2 from hemagglutinin__InfluenzaA__AIC73744
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucaaccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccgcccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103894 - RNA, 1701 nt, Artificial Sequence
  derived and/or modified sequence opt2 from hemagglutinin__InfluenzaA__AIC73745
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacugggcccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103895 - RNA, 1701 nt, Artificial Sequence
  derived and/or modified sequence opt2 from hemagglutinin__InfluenzaA__AIC73746
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucaccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccaccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103896 - RNA, 1701 nt, Artificial Sequence
  derived and/or modified sequence opt2 from hemagglutinin__InfluenzaA__AIC73747
augaaggccauccucgucguccuccucuacacccucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacaccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103897 - RNA, 1701 nt, Artificial Sequence; identical to SEQ ID NO: 101552
  derived and/or modified sequence opt2 from hemagglutinin__InfluenzaA__AIC73748

SEQ ID NO: 103898 - RNA, 1701 nt, Artificial Sequence
  derived and/or modified sequence opt2 from hemagglutinin__InfluenzaA__AIC73749
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcaagaacugcacccucaucgacgcccuccucggcgacccccagugcgacggcuuccagaacaagcgcugggaccucuucgucgagcgcuccaaggccuacuccaacugcuaccccuacgacguccccgacuacgccucccuccgcucccucgucgccuccuccggcacccucgaguucaacgacgaguccuucaacugggccggcgucacccagaacggcaccuccuccgccugcauccgcggcuccaacuccuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccacuccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaaguccgagugcaucacccccaacggcuccaucaccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugaaggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103899 - RNA, 1701 nt, Artificial Sequence; identical to SEQ ID NO: 101552
  derived and/or modified sequence opt2 from hemagglutinin__InfluenzaA__AIC73750

SEQ ID NO: 103900 - RNA, 1701 nt, Artificial Sequence
  derived and/or modified sequence opt2 from hemagglutinin__InfluenzaA__AIC73754
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacucccgcaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103901 - RNA, 1701 nt, Artificial Sequence; identical to SEQ ID NO: 101552
  derived and/or modified sequence opt2 from hemagglutinin__InfluenzaA__AIC73755

SEQ ID NO: 103902 - RNA, 1701 nt, Artificial Sequence; identical to SEQ ID NO: 101552
  derived and/or modified sequence opt2 from hemagglutinin__InfluenzaA__AIC73756

SEQ ID NO: 103903 - RNA, 1701 nt, Artificial Sequence; identical to SEQ ID NO: 101552
  derived and/or modified sequence opt2 from hemagglutinin__InfluenzaA__AIC73757

SEQ ID NO: 103904 - RNA, 1701 nt, Artificial Sequence
  derived and/or modified sequence opt2 from hemagglutinin__InfluenzaA__AIC73758
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcaucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103905 - RNA, 1701 nt, Artificial Sequence
  derived and/or modified sequence opt2 from hemagglutinin__InfluenzaA__AIC73760
augaaggccauccucaucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103906 - RNA, 1701 nt, Artificial Sequence; identical to SEQ ID NO: 103905
  derived and/or modified sequence opt2 from hemagglutinin__InfluenzaA__AIC73761

SEQ ID NO: 103907 - RNA, 1701 nt, Artificial Sequence; identical to SEQ ID NO: 103432
  derived and/or modified sequence opt2 from hemagglutinin__InfluenzaA__AIC73762

SEQ ID NO: 103908 - RNA, 1701 nt, Artificial Sequence
  derived and/or modified sequence opt2 from hemagglutinin__InfluenzaA__AIC73763
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagaucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103909 - RNA, 1701 nt, Artificial Sequence; identical to SEQ ID NO: 101552
  derived and/or modified sequence opt2 from hemagglutinin__InfluenzaA__AIC73765

SEQ ID NO: 103910 - RNA, 1701 nt, Artificial Sequence; identical to SEQ ID NO: 101552
  derived and/or modified sequence opt2 from hemagglutinin__InfluenzaA__AIC73766

SEQ ID NO: 103911 - RNA, 1701 nt, Artificial Sequence
  derived and/or modified sequence opt2 from hemagglutinin__InfluenzaA__AIC73767
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucaucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagauccgcaaccagcucaagaacaacgccaaggagaucggcaacggcugcuucgaguucuaccacaagugcgacaacaugugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103912 - RNA, 1701 nt, Artificial Sequence; identical to SEQ ID NO: 101552
  derived and/or modified sequence opt2 from hemagglutinin__InfluenzaA__AIC73768

SEQ ID NO: 103913 - RNA, 1701 nt, Artificial Sequence; identical to SEQ ID NO: 101552
  derived and/or modified sequence opt2 from hemagglutinin__InfluenzaA__AIC73769

SEQ ID NO: 103914 - RNA, 1701 nt, Artificial Sequence; identical to SEQ ID NO: 101552
  derived and/or modified sequence opt2 from hemagglutinin__InfluenzaA__AIC73770

SEQ ID NO: 103915 - RNA, 1701 nt, Artificial Sequence; identical to SEQ ID NO: 101552
  derived and/or modified sequence opt2 from hemagglutinin__InfluenzaA__AIC73771

SEQ ID NO: 103916 - RNA, 1701 nt, Artificial Sequence
  derived and/or modified sequence opt2 from hemagglutinin__InfluenzaA__AIC73772
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcgucuaccagauccucgccaucuacuccaccgucgccuccucccucguccucgucgucucccucggcgccaucuccuucuggaugugcuccaacggcucccuccagugccgcaucugcaucuga

SEQ ID NO: 103917 - RNA, 1701 nt, Artificial Sequence; identical to SEQ ID NO: 101552
  derived and/or modified sequence opt2 from hemagglutinin__InfluenzaA__AIC73773

SEQ ID NO: 103918 - RNA, 1701 nt, Artificial Sequence; identical to SEQ ID NO: 101552
  derived and/or modified sequence opt2 from hemagglutinin__InfluenzaA__AIC73775

SEQ ID NO: 103919 - RNA, 1701 nt, Artificial Sequence; identical to SEQ ID NO: 101552
  derived and/or modified sequence opt2 from hemagglutinin__InfluenzaA__AIC73776

SEQ ID NO: 103920 - RNA, 1701 nt, Artificial Sequence; identical to SEQ ID NO: 103916
  derived and/or modified sequence opt2 from hemagglutinin__InfluenzaA__AIC73777

SEQ ID NO: 103921 - RNA, 1701 nt, Artificial Sequence
  derived and/or modified sequence opt2 from hemagglutinin__InfluenzaA__AIC73778
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103922 - RNA, 1701 nt, Artificial Sequence; identical to SEQ ID NO: 103921
  derived and/or modified sequence opt2 from hemagglutinin__InfluenzaA__AIC73779

SEQ ID NO: 103923 - RNA, 1701 nt, Artificial Sequence; identical to SEQ ID NO: 103921
  derived and/or modified sequence opt2 from hemagglutinin__InfluenzaA__AIC73780

SEQ ID NO: 103924 - RNA, 1701 nt, Artificial Sequence; identical to SEQ ID NO: 102510
  derived and/or modified sequence opt2 from hemagglutinin__InfluenzaA__AIC73781

SEQ ID NO: 103925 - RNA, 1701 nt, Artificial Sequence; identical to SEQ ID NO: 103921
  derived and/or modified sequence opt2 from hemagglutinin__InfluenzaA__AIC73782

SEQ ID NO: 103926 - RNA, 1701 nt, Artificial Sequence; identical to SEQ ID NO: 103921
  derived and/or modified sequence opt2 from hemagglutinin__InfluenzaA__AIC73783

SEQ ID NO: 103927 - RNA, 1701 nt, Artificial Sequence; identical to SEQ ID NO: 103921
  derived and/or modified sequence opt2 from hemagglutinin__InfluenzaA__AIC73784

SEQ ID NO: 103928 - RNA, 1701 nt, Artificial Sequence; identical to SEQ ID NO: 101552
  derived and/or modified sequence opt2 from hemagglutinin__InfluenzaA__AIC73785

SEQ ID NO: 103929 - RNA, 1701 nt, Artificial Sequence; identical to SEQ ID NO: 103921
  derived and/or modified sequence opt2 from hemagglutinin__InfluenzaA__AIC73786

SEQ ID NO: 103930 - RNA, 1701 nt, Artificial Sequence; identical to SEQ ID NO: 101552
  derived and/or modified sequence opt2 from hemagglutinin__InfluenzaA__AIC73787

SEQ ID NO: 103931 - RNA, 1701 nt, Artificial Sequence; identical to SEQ ID NO: 101552
  derived and/or modified sequence opt2 from hemagglutinin__InfluenzaA__AIC73788

SEQ ID NO: 103932 - RNA, 1701 nt, Artificial Sequence
  derived and/or modified sequence opt2 from hemagglutinin__InfluenzaA__AIC73789
augaagaccaucaucgcccucuccuacauccucugccucgucuucgcccagaagccccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 103933 - RNA, 1701 nt, Artificial Sequence
  derived and/or modified sequence opt2 from hemagglutinin__InfluenzaA__AIC73790
augaaggccauccucgucguccuccucuacaccuucgccaccaccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcuccgccaguccuacaucaacgacaagggcaaggagguccucguccucuggggcauccaccaccccuccaccaccaccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103934 - RNA, 1701 nt, Artificial Sequence
  derived and/or modified sequence opt2 from hemagglutinin__InfluenzaA__AIC73791
augaaggccauccucgucguccuccucuacaccuucgccaccgccaacgccgacacccucugcaucggcuaccacgccaacaacuccaccgacaccaucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103935 - RNA, 1701 nt, Artificial Sequence; identical to SEQ ID NO: 101552
  derived and/or modified sequence opt2 from hemagglutinin__InfluenzaA__AIC73792

SEQ ID NO: 103936 - RNA, 1701 nt, Artificial Sequence; identical to SEQ ID NO: 103916
  derived and/or modified sequence opt2 from hemagglutinin__InfluenzaA__AIC73793

SEQ ID NO: 103937 - RNA, 1701 nt, Artificial Sequence
  derived and/or modified sequence opt2 from hemagglutinin__InfluenzaA__AIC73794
augaagaccaucaucggcgucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccuccugcauccgcggcuccaacuccuccuucuucucccgccucaacuggcucacccaccucaacuccaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagcgccagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103938 - RNA, 1701 nt, Artificial Sequence; identical to SEQ ID NO: 101552
  derived and/or modified sequence opt2 from hemagglutinin__InfluenzaA__AIC73796

SEQ ID NO: 103939 - RNA, 1701 nt, Artificial Sequence
  derived and/or modified sequence opt2 from hemagglutinin__InfluenzaA__AIC73797
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccuccugcauccgcggcuccaacuccuccuucuucucccgccucaacuggcucacccaccucaacuccaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagcgccagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103940 - RNA, 1701 nt, Artificial Sequence; identical to SEQ ID NO: 103939
  derived and/or modified sequence opt2 from hemagglutinin__InfluenzaA__AIC73798

SEQ ID NO: 103941 - RNA, 1701 nt, Artificial Sequence; identical to SEQ ID NO: 103939
  derived and/or modified sequence opt2 from hemagglutinin__InfluenzaA__AIC73800

SEQ ID NO: 103942 - RNA, 1701 nt, Artificial Sequence; identical to SEQ ID NO: 103939
  derived and/or modified sequence opt2 from hemagglutinin__InfluenzaA__AIC73801

SEQ ID NO: 103943 - RNA, 1701 nt, Artificial Sequence; identical to SEQ ID NO: 103939
  derived and/or modified sequence opt2 from hemagglutinin__InfluenzaA__AIC73802

SEQ ID NO: 103944 - RNA, 1701 nt, Artificial Sequence; identical to SEQ ID NO: 103939
  derived and/or modified sequence opt2 from hemagglutinin__InfluenzaA__AIC73803

SEQ ID NO: 103945 - RNA, 1701 nt, Artificial Sequence; identical to SEQ ID NO: 103939
  derived and/or modified sequence opt2 from hemagglutinin__InfluenzaA__AIC73804

SEQ ID NO: 103946 - RNA, 1701 nt, Artificial Sequence; identical to SEQ ID NO: 103939
  derived and/or modified sequence opt2 from hemagglutinin__InfluenzaA__AIC73805

SEQ ID NO: 103947 - RNA, 1701 nt, Artificial Sequence; identical to SEQ ID NO: 103939
  derived and/or modified sequence opt2 from hemagglutinin__InfluenzaA__AIC73806

SEQ ID NO: 103948 - RNA, 1701 nt, Artificial Sequence
  derived and/or modified sequence opt2 from hemagglutinin__InfluenzaA__AIC73807
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacaacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103949 - RNA, 1701 nt, Artificial Sequence; identical to SEQ ID NO: 103939
  derived and/or modified sequence opt2 from hemagglutinin__InfluenzaA__AIC73808

SEQ ID NO: 103950 - RNA, 1701 nt, Artificial Sequence
  derived and/or modified sequence opt2 from hemagglutinin__InfluenzaA__AIC73809
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcuccgccaguccuacaucaacgacaagggcaaggagguccucguccucuggggcauccaccaccccuccaccaccaccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacgaggucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103951 - RNA, 1701 nt, Artificial Sequence
  derived and/or modified sequence opt2 from hemagglutinin__InfluenzaA__AIC73810
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccaccgcugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103952 - RNA, 1701 nt, Artificial Sequence
  derived and/or modified sequence opt2 from hemagglutinin__InfluenzaA__AIC73813
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgccgccuccucccucguccucgucaucucccucggcgccaucuccuucuggaugugcuccaacggcucccuccagugccgcaucugcaucuga

SEQ ID NO: 103953 - RNA, 1701 nt, Artificial Sequence
  derived and/or modified sequence opt2 from hemagglutinin__InfluenzaA__AIC73815
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103954 - RNA, 1701 nt, Artificial Sequence; identical to SEQ ID NO: 103432
  derived and/or modified sequence opt2 from hemagglutinin__InfluenzaA__AIC73817

SEQ ID NO: 103955 - RNA, 1701 nt, Artificial Sequence; identical to SEQ ID NO: 101552
  derived and/or modified sequence opt2 from hemagglutinin__InfluenzaA__AIC73819

SEQ ID NO: 103956 - RNA, 1701 nt, Artificial Sequence
  derived and/or modified sequence opt2 from hemagglutinin__InfluenzaA__AIC73820
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccuccuccuccuucuucucccgccucaacuggcucacccaccucaacuacaccuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcgacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcacuccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacaucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103957 - RNA, 1701 nt, Artificial Sequence; identical to SEQ ID NO: 101552
  derived and/or modified sequence opt2 from hemagglutinin__InfluenzaA__AIC73821

SEQ ID NO: 103958 - RNA, 1701 nt, Artificial Sequence; identical to SEQ ID NO: 103916
  derived and/or modified sequence opt2 from hemagglutinin__InfluenzaA__AIC73824

SEQ ID NO: 103959 - RNA, 1701 nt, Artificial Sequence; identical to SEQ ID NO: 101552
  derived and/or modified sequence opt2 from hemagglutinin__InfluenzaA__AIC73825

SEQ ID NO: 103960 - RNA, 1701 nt, Artificial Sequence
  derived and/or modified sequence opt2 from hemagglutinin__InfluenzaA__AIC73827
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagccccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucauccucgucgucucccucggcgccaucuccuucuggaugugcuccaacggcucccuccagugccgcaucugcaucuga

SEQ ID NO: 103961 - RNA, 1701 nt, Artificial Sequence
  derived and/or modified sequence opt2 from hemagglutinin__InfluenzaA__AIC73828
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaccaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 103962 - RNA, 1701 nt, Artificial Sequence
  derived and/or modified sequence opt2 from hemagglutinin__InfluenzaA__AIC73830
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcucaagggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103963 - RNA, 1701 nt, Artificial Sequence
  derived and/or modified sequence opt2 from hemagglutinin__InfluenzaA__AIC73833
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgccgccuccucccucguccucgucgucucccucggcgccaucuccuucuggaugugcuccaacggcucccuccagugccgcaucugcaucuga

SEQ ID NO: 103964 - RNA, 1701 nt, Artificial Sequence
  derived and/or modified sequence opt2 from hemagglutinin__InfluenzaA__AIC73834
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgacggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccggccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103965 - RNA, 1701 nt, Artificial Sequence
  derived and/or modified sequence opt2 from hemagglutinin__InfluenzaA__AIC73835
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucaucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucucccucuggaugugcuccaacggcucccuccagugccgcaucugcaucuga

SEQ ID NO: 103966 - RNA, 1701 nt, Artificial Sequence; identical to SEQ ID NO: 103908
  derived and/or modified sequence opt2 from hemagglutinin__InfluenzaA__AIC73836

SEQ ID NO: 103967 - RNA, 1701 nt, Artificial Sequence
  derived and/or modified sequence opt2 from hemagglutinin__InfluenzaA__AIC73837
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugaaggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103968 - RNA, 1701 nt, Artificial Sequence
  derived and/or modified sequence opt2 from hemagglutinin__InfluenzaA__AIC73838
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcaacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggaccucggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103969 - RNA, 1701 nt, Artificial Sequence
  derived and/or modified sequence opt2 from hemagglutinin__InfluenzaA__AIC73839
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccgaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaccggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103970 - RNA, 1701 nt, Artificial Sequence; identical to SEQ ID NO: 101552
  derived and/or modified sequence opt2 from hemagglutinin__InfluenzaA__AIC73840

SEQ ID NO: 103971 - RNA, 1701 nt, Artificial Sequence
  derived and/or modified sequence opt2 from hemagglutinin__InfluenzaA__AIC73841
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaucgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103972 - RNA, 1701 nt, Artificial Sequence; identical to SEQ ID NO: 103967
  derived and/or modified sequence opt2 from hemagglutinin__InfluenzaA__AIC73842

SEQ ID NO: 103973 - RNA, 1707 nt, Artificial Sequence
  derived and/or modified sequence opt2 from hemagglutinin__InfluenzaA__AID48082
auggagaagaucguccuccucuucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucgacggcgucaagccccucauccuccgcgacugcuccgucgccggcuggcuccucggcaaccccaugugcgacgaguucaucaacguccccgagugguccuacaucgucgagaaggccaaccccgucaacgaccucugcuaccccggcgacuucaacgacuacgaggagcucaagcaccuccucucccgcaucaaccacuucgagaagauccagaucauccccaaguccuccugguccucccacgaggccucccucggcgucuccuccgccugccccuaccagggcaaguccuccuucuuccgcaacgucgucuggcucaucaagaagaacuccaccuaccccaccaucaagcgcuccuacaacaacaccaaccaggaggaccuccucguccucuggggcauccaccaccccaacgacgccgccgagcagaccaagcucuaccagaaccccaccaccuacaucuccgucggcaccuccacccucaaccagcgccucgucccccgcaucgccacccgcuccaaggucaacggccaguccggccgcauggaguucuucuggaccauccucaagcccaacgacgccaucaacuucgaguccaacggcaacuucaucgcccccgaguacgccuacaagaucgucaagaagggcgacuccaccaucaugaaguccgagcucgaguacggcaacugcaacaccaagugccagacccccaugggcgccaucaacuccuccaugcccuuccacaacauccacccccucaccaucggcgagugccccaaguacgucaaguccaaccgccucguccucgccaccggccuccgcaacuccccccagcgcgagcgccgccgcaagaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaaccaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacgacgagugcauggaguccguccgcaacggcaccuacgacuacccccaguacuccgaggaggcccgccucaagcgcgaggagaucuccggcgucaagcucgaguccaucggcaucuaccagauccucuccaucuacuccaccgucgccuccucccucgcccucgccaucauggucgccggccucucccucuggaugugcuccaacggcucccuccagugccgcaucugcaucuga

SEQ ID NO: 103974 - RNA, 1701 nt, Artificial Sequence
  derived and/or modified sequence opt2 from hemagglutinin__InfluenzaA__AID70444
augaaggccguccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucgccaccgccuccuccugguccuacaucgucgagaccuccaacuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggccgcgagguccucguccucuggggcauccaccaccccuccaccuccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucgucguccucgagaacgagcgcacccucgaguaccacgacuccaacgucaagaaccucuacgagaagguccgcucccaggucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuucaacggcucccuccagugccgcaucuacaucuga

SEQ ID NO: 103975 - RNA, 1701 nt, Artificial Sequence
  derived and/or modified sequence opt2 from hemagglutinin__InfluenzaA__AID70445
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucgucguccucgagaacgagcgcacccucgaguaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaucuacgacuaccccaaguacuccgaggaggccaagcucaaccgcgaggagaucgacggcgucaagcucgaguccacccgcaucuaccagauccucgccaucuacuccaccgucgccuccucccucguccaggucgucucccucggcgccaucuccuucuggaugugcuucaacggcucccuccagugccgcaucugcaucuga

SEQ ID NO: 103976 - RNA, 1701 nt, Artificial Sequence
  derived and/or modified sequence opt2 from hemagglutinin__InfluenzaA__AID70446
augaaggccguccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagauccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccggcacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucgucguccucgagaacgagcgcacccucgaguaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaucuacgacuaccccaaguacuccgaggaggccaagcucaaccgcgaggagaucgacggcgucaagcucgaguccacccgcaucuaccagauccucgccaucuacuccaccgucgccuccucccucguccaggucgucucccucggcgccaucuccuucuggaugugcuucaacggcucccuccagugccgcaucugcaucuga

SEQ ID NO: 103977 - RNA, 1701 nt, Artificial Sequence
  derived and/or modified sequence opt2 from hemagglutinin__InfluenzaA__AID70447
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccaggccggcgccaagggcuucuacaagaaccuccucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccuccgucggcaaggaguucaaccaccucgagaagcgcauggagaaccucaacaagaaggucgacgacggcuuccucgacaucuggaccuacaacgccgagcuccucgucguccucgagaacgagcgcacccucgaguaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaucuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuucaacggcucccuccagugccgcaucugcaucuga

SEQ ID NO: 103978 - RNA, 1701 nt, Artificial Sequence
  derived and/or modified sequence opt2 from hemagglutinin__InfluenzaA__AID70448
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcgacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucgucguccucgagaacgagcgcacccucgaguaccaggacuccaacgucaagaaccucuacgagaagguccgcaaccagcucaagaacaacgccaaggagaucggcaacggcugccucgaguucuaccacaaguucgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcaccaucuccuucuggaugugcuucaacggcucccuccagugccgcaucugcaucuga

SEQ ID NO: 103979 - RNA, 1701 nt, Artificial Sequence
  derived and/or modified sequence opt2 from hemagglutinin__InfluenzaA__AID70449
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucgucguccucgagaacgagcgcacccucgaguaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuucaacggcucccuccagugccgcaucugcgucuga

SEQ ID NO: 103980 - RNA, 1701 nt, Artificial Sequence
  derived and/or modified sequence opt2 from hemagglutinin__InfluenzaA__AID70450
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcgacgccggcuccggcaucaucaucuccgacacccccguccacgacugcaacaccaccugccagaccuccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucgucguccucgagaacgagcgcacccucgaguaccacgacuccaacgucaagaaccucuacgagaagguccgcaaccagcucaagaacaacgccaaggagaucggcaacggcugcuucgaguucuaccacaaguucgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccaggucgucucccucggcgccaucuccuucuggaugugcuucaacggcucccuccagugccgcaucugcaucuga

SEQ ID NO: 103981 - RNA, 1701 nt, Artificial Sequence
  derived and/or modified sequence opt2 from hemagglutinin__InfluenzaA__AID70451
augaaggccauccucgucgucaugcucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucgucguccucgagaacgagcgcacccucgaguaccacgacuccaacgucaagaaccucuacgagaagguccgcaaccagcucaagaacaacgccaaggagaucggcaacggcugcuucgaguucuaccacaaguucgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuucaacggcucccuccagugccgcaucugcaucuga

SEQ ID NO: 103982 - RNA, 1701 nt, Artificial Sequence
  derived and/or modified sequence opt2 from hemagglutinin__InfluenzaA__AID70452
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucggcuccgucuccuccuucaagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcgacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucgucguccucgagaacgagcgcacccucgaguaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaucuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugcgcuucaacggcucccuccagugcuccaucugcaucuga

SEQ ID NO: 103983 - RNA, 1701 nt, Artificial Sequence
  derived and/or modified sequence opt2 from hemagglutinin__InfluenzaA__AID70453
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcgacgccggcuccggcaucaucaucuccgacacccccguccaggacugcaacaccaccugccagacccccaagggcgccaucaacaccucccuccccuuccagaacauccaccccaucaccaucggcaagugccccaaguacgucaaguccaccaagcuccgccucgucaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucgucguccucgagaacgagcgcacccucgaguaccacgacuccaaccucaagaaccucuacgagaagguccgcaaccagcucaagaacaacgccaaggagaucggcaacggcugcuucgaguucuaccacaaguucgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccaggucgucucccucggcgccaucuccuucuggaugcgcuucaacggcucccuccacugccgcaucugcaucuga

SEQ ID NO: 103984 - RNA, 1701 nt, Artificial Sequence
  derived and/or modified sequence opt2 from hemagglutinin__InfluenzaA__AID70454
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagaugcgccucgccaccggccuccgcaacguccccugcauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucgucguccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 103985 - RNA, 1701 nt, Artificial Sequence
  derived and/or modified sequence opt2 from hemagglutinin__InfluenzaA__AID70455
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcucggcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagaucuccaaguccuacaucaacgacaagggcaaggagguccucguccucuggggcauccaccaccccuccaccaccgccgaccagcagucccucuaccagaacgccgacaccuacaucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcgacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucaagaagaugaacacccaguucaccgccgucggcaaggaguucaaccaccucgagaagcgcaucgagaaccucaacaagaaggucgacgacggcuuccucgacaucuggaccuacaacgccgagcuccucgucguccucgagaacgagcgcacccucgaguaccacgacuccaacgucaagaaccucuacgagaagguccgcaaccagcucaagaacaacgccaaggagaucggcaacggcugcuucgaguucuaccacaaguucgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuucaacggcucccuccagugccgcaucugcaucuga

SEQ ID NO: 103986 - RNA, 1701 nt, Artificial Sequence
  derived and/or modified sequence opt2 from hemagglutinin__InfluenzaA__AID70456
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucgucaaggaguucaaccaccucgagaagcgcaucgagaaccucaacaagaaggucgacgacggcuuccucgacaucuggaccuacaacgccgagcuccucgucguccucgagaacgagcgcacccucgaguaccacgacuccaaccucaagaaccucuacgagaagguccgcaaccagcucaagaacaacgccaaggagaucggcaacggcugcuucgaguucuaccacaaguucgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccaggucgucucccucggcgccaucuccuucuggaugugcuucaacggcucccuccagugccgcaucugcaucuga

SEQ ID NO: 103987 - RNA, 1701 nt, Artificial Sequence
  derived and/or modified sequence opt2 from hemagglutinin__InfluenzaA__AID70457
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaagggcuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacaccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcgacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucgucguccucgagaacgagcgcacccucgaguaccacgacuccaacgucaagaaccucuacgagaagguccgcaaccagcucaagaacaacgccaaggagaucggcaacggcugcuucgaguucuaccacaaguucgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccaggucgucucccucggcgccaucuccuucuggaagugcuucaacggcucccuccagugccgcaucugcuccuga

SEQ ID NO: 103988 - RNA, 1701 nt, Artificial Sequence
  derived and/or modified sequence opt2 from hemagglutinin__InfluenzaA__AID70458
augaagaccaucaucgcccucuccuacauccucugccucgucuucgcccagaaguuccccggcaacgacaacuccauggccacccucugccucggccaccacgccguccccaacggcaccauggucaagaccaucaccaacgaccagaucgaggucaccaacgccaccgagcucguccaguccuccuccaccggcggcaucugcaacuccccccaccagauccucgacggcggcaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcuccaucgucgccuccuccggcacccucgaguucaacaacgaguccuucaacuggaccggcgucacccagaacggcaaguccgccuccugcaagcgcggcuccgacaacuccuucuucucccgccucaacuggcucacccaccucaacuacaaguaccccgcccucaaggucaccaugcccaacaacgagaaguucgacaagcucuacaucuggggcguccaccaccccggcaccuacaacgaccagaucucccucuacgcccaggccuccggcaucaucaccgucuccaccaagcgcaaccagcagaccgucauccccaacaucggcucccgcccccgcguccgcgacauccccucccgcaucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaugggccaggccgccgaccucaaguccacccaggccgccaucaaccagaucaacggcaagcucaaccgccucaucggcaagaccaucgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagauggacaagcucuucgagcgcaccaagaagcagaugcgcgagaacgccgaggacaugggcaacggcugcuucaagaucuaccacaagugcgacaacgccugcaucggcuccauccgcaacggcaucuacgaccgcgacaucuaccgcgacgaggcccucuccaaccgcuuccagaucaagggcgucgagcucaaggccggcuacaaggacuggauccucuggaucuccuucgccaucuccugcuuccuccucugcgucguccuccucggcuucaucaugugggccugccagaagggcaaccuccgcugcaacaucugcaucuga

SEQ ID NO: 103989 - RNA, 1701 nt, Artificial Sequence
  derived and/or modified sequence opt2 from hemagglutinin__InfluenzaA__AID70459
augaagaccaucaucgcccucuccuacauccucugccucgucuucgcccagaagguccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagaagucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgcccccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaucgagaaguuccaccagaucgagaacgaguucuccgaggucgagggccgcauccaggaccucgagaaguacgucgaggacaccaagaucgaccucugguccuacaucgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaucuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103990 - RNA, 1701 nt, Artificial Sequence
  derived and/or modified sequence opt2 from hemagglutinin__InfluenzaA__AID70460
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagaagucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaucgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaucuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103991 - RNA, 1701 nt, Artificial Sequence
  derived and/or modified sequence opt2 from hemagglutinin__InfluenzaA__AID70461
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagaagucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaucgagaaguuccaccagaucgagaaggaguucuccgaggucgagggccgcauccaggaccucgagaaguacaucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaucuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaucaccugcaucuga

SEQ ID NO: 103992 - RNA, 1701 nt, Artificial Sequence
  derived and/or modified sequence opt2 from hemagglutinin__InfluenzaA__AID70463
augaagaccaucaucgcccucuccuacauccucugccucgucuucgcccagaagauccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagaagucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaucgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaucuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103993 - RNA, 1701 nt, Artificial Sequence
  derived and/or modified sequence opt2 from hemagglutinin__InfluenzaA__AID70464
augaagaccaucaucgcccucuccuacauccucugccucgucuucgcccagaagcuccccggcgacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagaagucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaucgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103994 - RNA, 1701 nt, Artificial Sequence
  derived and/or modified sequence opt2 from hemagglutinin__InfluenzaA__AID70465
augaagaccaucaucgcccucuccuacauccucugccucgucuucgcccagaagcuccccggcgacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagaagucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaucgagaaguuccaccagaucgagaaggaguucuccgaggucgagggccgcauccaggaccucgagaaguacgucgaggacaccaagaucgaccucugguccuacaacgccgagcuccucgucgcccucgagaaccaccacgccaucgaccucaccgacuccgagaugaacaagcucuucgagaagaccaagaagcagaugcgcgagaacgccgaggacaugggcaacggcugcuucaagaucuaccucaagugcgacaacgccugcaucggcuccauccgcaacggcaucuacgaccacgacgucuaccgcgacgaggcccucaacaaccgcuuccagaucaagggcgucgagcucaaguccggcuacaaggacuggauccucuggaucuccuucaccgaguccugcuuccuccucugcgucgcccuccucggcuucaucaugugggccugccagaagggcaacauccgcugcaacaucugcaucuga

SEQ ID NO: 103995 - RNA, 1701 nt, Artificial Sequence
  derived and/or modified sequence opt2 from hemagglutinin__InfluenzaA__AID70466
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagaagucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaucgagaaguuccaccagaucgagaacgaguucuccgaggucgagggccgcauccaggaccucgagaaguacgucgaggacaccaagaucgaccucugguccuacaucggcgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaucuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103996 - RNA, 1701 nt, Artificial Sequence
  derived and/or modified sequence opt2 from hemagglutinin__InfluenzaA__AID70467
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagaagucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacugcgagggccgcggccaggccgccgaccucaaguccacccaggccgccaucgaccagaucaacggcaagcucaaccgccucaucggcaagaccaucgagaaguuccaccagaucgagaacgaguucuccgaggucgagggccgcauccagggccucgagaaguacgucgaggacaccaagaucgaccucugguccuacaucgccgagcucaucgucgcccucgagaaccagcacaccaucgaccucaccgacuccgagaugaacaagcucuucgagaagaccaagaagcagaugcgcgagaacgccgaggacaugggcaacggcugcuucaagaucuaccacaagugcgacaacgccugcaucggcuccauccgcaacggcaucuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 103997 - RNA, 1701 nt, Artificial Sequence
  derived and/or modified sequence opt2 from hemagglutinin__InfluenzaA__AID70468
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacugcgagggccgcggccaggccgccgaccucaaguccacccaggccgccaucgaccagaucaacggcaagcucaaccgccucaugggcaaguccaucgagaaguuccaccagaucgagaacgaguucuccgaggucgagggccgcauccagggccucgagaaguacgucgaggacaccaagaucgaccucugguccuacaacggcgagcucaucgucgcccucgagaaccagcacgccaucgaccucaccgacuccgagaugaacaagcucuucgagaagaccaagaagcagaugcgcgagaacgccgaggacaugggcaacggcugcuucaagaucuaccucaagugcgacaacgccugcaucggcuccauccgcaacggcaucuacgaccacgacgucuaccgcgacgaggcccucaacaaccgcuuccagaucaagggcgucgagcucaaguccggcuacaaggacuggauccucuggaucuccuucaccaucuccugcuuccuccucugcgucgcccuccucggcuucaucaugugggcccgccagaagggcaacauccgcugcaacaucugcaucuga

SEQ ID NO: 103998 - RNA, 1701 nt, Artificial Sequence
  derived and/or modified sequence opt2 from hemagglutinin__InfluenzaA__AID70469
augaagaccaucaucgcccucuccuacauccucugccucgucuucgcccagaagguccccggcaacgagaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacugcgagggccgcggccaggccgccgaccucaaguccacccaggccgccaucgaccagaucaacggcaagcucaaccgccucaucggcaagaccaucgagaaguuccaccagaucgagaaggaguucuccgaggucgagggccgcauccagggccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagaugcgcgagaacgccgaggacaugggcaacggcugcuucaagaucuaccacaagugcgacaacgccugcaucggcuccauccgcaacggcaucuacgaccacgacgucuaccgcgacgaggcccucaacaaccgcuuccagaucaagggcgucgagcucaaguccggcuacaaggacuggauccucuggaucuccuucaccaucuccugcuuccuccucugcgucgcccuccucggcuucaucaugugggccugccagaagggcaacauccgcugcaacaucugcaucuga

SEQ ID NO: 103999 - RNA, 1701 nt, Artificial Sequence
  derived and/or modified sequence opt2 from hemagglutinin__InfluenzaA__AID70470
augaagaccaucaucgcccucuccuacauccucugccucgucuucgcccagaagguccccggcaacgagaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacugcgagggccgcggccaggccgccgaccucaaguccacccaggccgccaucgaccagaucaacggcaagcucaaccgccucaucggcaagaccaucgagaaguuccaccagaucgagaaggaguucuccgaggucgagggccgcauccagggccucgagaaguacgucgaggacaccaagaucgaccucugguccuacaacggcgagcuccucgucgcccucgagaaccaccacaccaucgaccucaccgacuccgagaugaacaagcucuucgagaagaccaagaagcagaugcgcgagaacgccgaggacaugggcaacggcugcuucaagaucuaccacaagugcgacaacgccugcaucggcuccauccgcaacggcaucuacgaccacgacgucuaccgcgacgaggcccucaacaaccgcuuccagaucaagggcgucgagcucaaguccggcuacaaggacuggauccucuggaucuccuucaccaucuccugcuuccuccucugcgucgcccuccucggcuucaucaugugggccugccagaagggcaacauccgcugcaacaucugcaucuga

SEQ ID NO: 104000 - RNA, 1701 nt, Artificial Sequence
  derived and/or modified sequence opt2 from hemagglutinin__InfluenzaA__AID70471
augaagaccaucaucgcccucuccuacauccucugccucgucuucacccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagaagucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaucgagaaguuccaccagaucgagaacgaguucuccgaggucgagggccgcauccaggaccucgagaaguacgucgaggacaccaagaucgaccucugguccuacaacgccgagcucaucgucgcccucgagaaccaccacaccaucgaccucaccgacuccgagaugaacaagcucuucgagaagaccaagaagcagaugcgcgagaacgccgaggacaugggcaacggcugcuucaagaucuaccacaagugcgacaacgccugcaucggcuccauccgcaacggcaucuacgaccacgacgucuaccgcgacgaggcccucaacaaccgcuuccagaucaagggcgucgagcucaaguccggcuacaaggacuggauccucuggaucuccuucgccaucuccugcuuccucaucugcgucgcccuccucggcuucaucaugugggccugccagaagggcaaccuccgcugcaacaucugcaucuga

SEQ ID NO: 104001 - RNA, 1701 nt, Artificial Sequence
  derived and/or modified sequence opt2 from hemagglutinin__InfluenzaA__AID70472
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagaagucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaucgagaaguuccaccagaucgagaaggaguucuccgaggucgagggccgcauccaggaccucgagaaguacgucgaggacaccaagaucgaccucugguccuacaacgccgagcuccucgucgcccucgagaaccaccacaccaucgaccucaccgacuccgagaugaacaagcucuucgagaagaccaagaagcagaugcgcgagaacgccgaggacaugggcaacggcugcuucaagaucuaccacaagugcgacaacgccugcaucggcuccauccgcaacggcaucuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104002 - RNA, 1701 nt, Artificial Sequence
  derived and/or modified sequence opt2 from hemagglutinin__InfluenzaA__AID70473
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagaagucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacugcgagggccgcggccaggccgccgaccucaaguccacccaggccgccaucgaccagaucaacggcaagcucaaccgccucaucggcaagaccaucgagaaguuccaccagaucgagaaggaguucuccgaggucgagggccgcauccagggccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagaugcgcgagaacgccgaggacaugggcaacggcugcuucaagaucuaccacaagugcgacaacgccugcaucggcuccauccgcaacggcaucuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104003 - RNA, 1701 nt, Artificial Sequence
  derived and/or modified sequence opt2 from hemagglutinin__InfluenzaA__AID70474
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagaagucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacgucugggagggcauggucgacggcugguucggcuuccgccaccagaucugcgagggccgcggccaggccgccggccucgaguccacccaggccgccaucgaccagaucaacggcaagaugaaccgccucaugggcaagaccaucggcaaguuccaccagaucgucaacgaguucuccgaggucgagggccgcauccaggaccucgagaaguacgucgaggacaccaagaucgaccucugguccuacaucggcgagcuccucgucgcccucgagaaccaccacgccaucgaccucaccgacuccgagaugaacaagcucuucgagaagaccaagaagcagaugcgcgagaacgccgaggacaugggcaacggcugcuucaagaucuaccacaagugcgacaacgccugcaucggcuccauccgcaacggcaucuacgaccgcgacgucuaccgcgacgaggcccucaacaaccgcuuccacaucaagggcgucgagcucaaguccggcuacaaggacuggaucaucuggaucuccuccaccgaguccugcuuccuccucugcgucgcccuccucggcuucaucaugugggccugccagaagggcaacauccgcuccaacaucugcaucuga

SEQ ID NO: 104004 - RNA, 1701 nt, Artificial Sequence
  derived and/or modified sequence opt2 from hemagglutinin__InfluenzaA__AID70475
augaagaccaucaucgcccucuccuacaugcucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagaagucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacgucugggagggcauggucgacggcugguacggcuuccgccaccagaacugcgagggccgcggccaggccgccgaccucaaguccgcccaggccgccaucgaccccaucaacggcaagcucaaccgccucaugggcaagaccaucggcaaguuccaccagaucgagaaggaguucuccgaggucgagggccgcauccaggaccucgagaaguacgucgaggacaccaagaucgaccucugguccuacaacggcgagcuccucgucgcccucgagaaccagcacgccaucgaccucaccgacuccgagaugaacaaggucuucgagaagaccaagaagcagcuccgcgagaacgccgaggacaugggcaacggcugcuucaagaucuaccacaagugcgacaacgccugcaucggcuccauccgcaacggcaucuacgaccacgacgucuaccgcaacgaggcccucaacaaccgcuuccagaucaagggcgucgagcucaaguccggcuacaaggacuggauccucuggaucuccuucgccaucuccugcuuccuccucuccgucgccucccucggcuucaucaugugggccuaccagaagggcaacauccgcugcaacaucugcaucuga

SEQ ID NO: 104005 - RNA, 1701 nt, Artificial Sequence
  derived and/or modified sequence opt2 from hemagglutinin__InfluenzaA__AID70476
augaagaccaucaucgcccucuccuacauccucugccucgucuucgcccagaagcuccccggcaacgagaacuccaccgccacccucggccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacgacuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagaagucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacaaccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaucgagaaguuccaccagaucgagaaggaguucuccgaggucgagggccgcauccagggccgcgagaaguacgucgaggacaccaagaucgaccucugguccuacaucggcgaguucaucgucgcccucgagaaccagcacaccaucgaccucaccgacuccgagaugaacaagcucuucgagaagaccaagaagcagaugcgcgagaacgccgaggacaugggcaacggcugcuucaagaucuaccacaagugcgacaacgccugcaucggcuccauccgcaacggcaucuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104006 - RNA, 1701 nt, Artificial Sequence
  derived and/or modified sequence opt2 from hemagglutinin__InfluenzaA__AID70477
augaagaccaucaucgcccucuccuacauccucugccucgucuucgcccagaagcuccccggcaacgacuccuccaccggcacccucugccucggccaccacgccguccccaacggcaccaucgucaagaccaucaccaacgaccagaucgaggucaccaacgccaccgagcucguccaguccuccuccaccggcgagaucugcaaccgcccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucuccauccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagaagucccagcaggccgucauccccaacaucggcucccgcccccgcguccgcaacauccccucccgcgucuccaucuacuggaccaucgucaagcccggcgagauccuccucaucaacuccaccggcaaccucaucgccccccgcggcuacuucaagauccgcuccggcaaguccuccaucaugcgcuccgacgcccccaucggcaagugcuacuccgccugcaucacccccaacggcuccauccccaacgacaagcccuuccagaacgucaaccgcaucaccuacggcgccugcccccgcuacgucaagcagcacccccucaagcucgccaccggcaugcgcaacguccccgagaagcagacccgcggcaucuucggcgccaucgccggcuucaucgagaacggcugggagggcauggucgacggcugguacggcuuccgccaccagaucugcgagggccgcggccaggccgccgaccucaaguccacccaggccgccaucgaccagaucaacggcaagcucaaccgccucaucggcaagaccaucgagaaguuccaccagaucgagaaggaguucuccgaggucgaguggcgcauccagggccucgagaaguacgucgaggacaccaaggucgaccucugguccuacaacggcgagcucaucgucgcccucgagaaccaccacaccaucgaccucaccgacuccgagaugaacaagcucuucgagaagaccaagaagcagaugcgcgagaacgccgaggacaugggcaacggcugcuucaagaucuaccucaagugcgacaacgccugcaucggcuccauccgcaacggcaucuacgaccacgacgucuaccgcgacgaggcccucaacaaccgcuuccagaucaagggcgucgagcucaaguccggcuacaaggacuggauccucuggaucuccuucaccgaguccugcuuccuccucuccgucgcccuccucggcuucaucaugugggccugccagaagggcaacauccgcugcaacaucugcaucuga

SEQ ID NO: 104007 - RNA, 1701 nt, Artificial Sequence
  derived and/or modified sequence opt2 from hemagglutinin__InfluenzaA__AID70478
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagaagucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacugcgagggccgcggccaggccgccgaccucgaguccacccaggccgccaucgaccagaucaacggcaagaugaaccgccucaugggcaagaccaucgagaaguuccaccagaucgagaaggaguucuccgaggucgagggccgcauccagggccgcgagaaguacgucgaggacaccaagaucgaccucugguccuacaacggcgagcuccucgucgaccucgagaaccagcacaccaucgaccucaccgacuccgagaugaacaaggucuucgagaagaccaagaagcagaugcgcgagaacgccgaggacaugggcaacggcugcuucaagaucuaccacaagugcgacaacgccugcaucggcuccauccgcaacggcaucuacgaccacgacgucuaccgcgacgaggcccucaacaaccgcuuccagaucaagggcgucgagcucaaguccggcuacaaggacuggauccaguggaucuccuucaccaucuccugcuuccuccucugcgucucccuccucggcuucaucaugugggccugccagaagggcaacauccgcugcaacaucugcaucuga

SEQ ID NO: 104008 - RNA, 1701 nt, Artificial Sequence; identical to SEQ ID NO: 101552
  derived and/or modified sequence opt2 from hemagglutinin__InfluenzaA__AID70632

SEQ ID NO: 104009 - RNA, 1683 nt, Artificial Sequence
  derived and/or modified sequence opt2 from hemagglutinin__InfluenzaA__AID70634
augaacacccagauccucgucuucgcccucaucgccaucauccccaccaacgccgacaagaucugccucggccaccacgccgucuccaacggcaccaaggucaacacccucaccgagcgcggcgucgaggucgucaacgccaccgagaccgucgagcgcaccaacaucccccgcaucugcuccaagggcaagcgcaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggaggccaugggcuucaccuacuccggcauccgcaccaacggcgccaccuccgccugccgccgcuccggcuccuccuucuacgccgagaugaaguggcuccucuccaacaccgacaacgccgccuucccccagaugaccaaguccuacaagaacacccgcaagucccccgcccucaucgucuggggcauccaccacuccgucuccaccgccgagcagaccaagcucuacggcuccggcaacaagcucgucaccgucggcuccuccaacuaccagcaguccuucguccccucccccggcgcccgcccccaggucaacggccucuccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacuccggcggcaccaucaucuccaaccuccccuuccagaacaucgacucccgcgccgucggcaagugcccccgcuacgucaagcagcgcucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucgaccagaucaccggcaagcucaaccgcaucaucgagaagaccaaccagcaguucgagcucaucgacaacgaguucaacgaggucgagaagcagaucuccaacgucaucaacuggacccgcgacuccaucaccgaggucugguccuacaacgccgagcuccucgucgccauggagaaccagcacaccaucgaccucgccgacuccgagauggacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgucaugggccucgucuucaucugcgucaagaacggcaacaugcgcugcaccaucugcaucuga

SEQ ID NO: 104010 - RNA, 1701 nt, Artificial Sequence
  derived and/or modified sequence opt2 from hemagglutinin__InfluenzaA__AIF72902
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccgccggcgagaucugcgacuccccccaccagauccucgacggcgagaacugcacccucaucgacgcccuccucggcgacccccagugcgacggcuuccagaacaagaagugggaccucuucgucgagcgcucccgcgccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104011 - RNA, 1701 nt, Artificial Sequence
  derived and/or modified sequence opt2 from hemagglutinin__InfluenzaA__AIF72903
augaagaccaucaucgcccucuccuacauccucugccucgucuucgcccaggagcuccccggcaacgacaacuccaccgccacccucugccucggccaccacgccguccccaacggcaccaucgucaagaccaucaccaacgaccagaucgaggucaccaacgccaccgagcucguccaguccuccuccgccggcgagaucugcgacuccccccaccagauccucgacggcgagaacugcacccucaucgacgcccuccucggcgacccccagugcgacggcuuccagaacaagaagugggaccucuucgucgagcgcucccgcgccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggguccucuggaucuccuucgccaucuccugcuuccuccucugcgucgcccuccucggcuucaucaugugggccugccagaagggcaacauccgcugcaacaucugcaucuga

SEQ ID NO: 104012 - RNA, 1701 nt, Artificial Sequence
  derived and/or modified sequence opt2 from hemagglutinin__InfluenzaA__AIF72904
augaagaccaucaucgcccucuccuacauccucugccucgucuucgcccaggagcuccccggcaacgacaacuccaccgccacccucugccucggccaccacgccguccccaacggcaccaucgucaagaccaucaccaacgaccagaucgaggucaccaacgccaccgagcucguccaguccuccuccgccggcgagaucugcgacuccccccaccagauccucgacggcgagaacugcacccucaucgacgcccuccucggcgacccccagugcgacggcuuccagaacaagaagugggaccucuucgucgagcgcucccgcgccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggguccucuggaucuccuucgccaucuccugcuuccuccucugcgucgcccuccucggcuucaucaugugggccugccagaagggcaacauccgcugcaacaucugcaucuga

SEQ ID NO: 104013 - RNA, 1701 nt, Artificial Sequence
  derived and/or modified sequence opt2 from hemagglutinin__InfluenzaA__AIF72905
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccgccggcgagaucugcgacuccccccaccagauccucgacggcgagaacugcacccucaucgacgcccuccucggcgacccccagugcgacggcuuccagaacaagaagugggaccucuucgucgagcgcucccgcgccuacuccaacugcuaccccuacgacguccccgacuacgccucccuccgcucccucgucgccuccuccggcacccucgaguucaagaacgaguccuucaacuggaccggcgucacccagaacggcaccuccuccgccugcauccgccgcuccaacaacuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104014 - RNA, 1701 nt, Artificial Sequence; identical to SEQ ID NO: 94923
  derived and/or modified sequence opt2 from hemagglutinin__InfluenzaA__AIF72906

SEQ ID NO: 104015 - RNA, 1701 nt, Artificial Sequence; identical to SEQ ID NO: 94923
  derived and/or modified sequence opt2 from hemagglutinin__InfluenzaA__AIF72907

SEQ ID NO: 104016 - RNA, 1701 nt, Artificial Sequence; identical to SEQ ID NO: 94923
  derived and/or modified sequence opt2 from hemagglutinin__InfluenzaA__AIF72908

SEQ ID NO: 104017 - RNA, 1701 nt, Artificial Sequence
  derived and/or modified sequence opt2 from hemagglutinin__InfluenzaA__AIF72909
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccgccggcgagaucugcgacggcccccaccagauccucgacggcgagaacugcacccucaucgacgcccuccucggcgacccccagugcgacggcuuccagaacaagaagugggaccucuucgucgagcgcucccgcgccuacuccaacugcuaccccuacgacguccccgacuacgccucccuccgcucccucgucgccuccuccggcacccucgaguucaacaacgaguccuucaacuggaccggcaccacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104018 - RNA, 1701 nt, Artificial Sequence; identical to SEQ ID NO: 94923
  derived and/or modified sequence opt2 from hemagglutinin__InfluenzaA__AIF72910

SEQ ID NO: 104019 - RNA, 1701 nt, Artificial Sequence; identical to SEQ ID NO: 94923
  derived and/or modified sequence opt2 from hemagglutinin__InfluenzaA__AIF72911

SEQ ID NO: 104020 - RNA, 1701 nt, Artificial Sequence; identical to SEQ ID NO: 104010
  derived and/or modified sequence opt2 from hemagglutinin__InfluenzaA__AIF72912

SEQ ID NO: 104021 - RNA, 1701 nt, Artificial Sequence; identical to SEQ ID NO: 94923
  derived and/or modified sequence opt2 from hemagglutinin__InfluenzaA__AIF72913

SEQ ID NO: 104022 - RNA, 1701 nt, Artificial Sequence
  derived and/or modified sequence opt2 from hemagglutinin__InfluenzaA__AIF72914
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcggcggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccacgaccucgagaaguacgucgaggacacccucuucgaccucugggucuacaacuccgagcuccucgucgcccuccagaaccagcacaccaucgaccuccccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104023 - RNA, 1701 nt, Artificial Sequence
  derived and/or modified sequence opt2 from hemagglutinin__InfluenzaA__AIF72915
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccuccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccaacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104024 - RNA, 1701 nt, Artificial Sequence; identical to SEQ ID NO: 94923
  derived and/or modified sequence opt2 from hemagglutinin__InfluenzaA__AIF72916

SEQ ID NO: 104025 - RNA, 1701 nt, Artificial Sequence
  derived and/or modified sequence opt2 from hemagglutinin__InfluenzaA__AIF72917
augaagaccaucaucgcccucuccuacauccucugccucgucuucgcccagaagcucccccgcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaagaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcgacaucugcaucuga

SEQ ID NO: 104026 - RNA, 1683 nt, Artificial Sequence
  derived and/or modified sequence opt2 from hemagglutinin__InfluenzaA__AIG44693
auggagaccgccucccucaucaccauccuccucgucgucaccgucuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccucccucggccagccccucauccucgacaccugcaccaucgagggccucaucuacggcaaccccuccugcgaccuccuccucggcggccgcgagugguccuacaucgucgagcgccccuccgccgucaacggccucugcuaccccggcaacgucgagaaccucgaggagcuccgcucccucuucuccuccgcccgcuccuaccagcgcauccagaucuuccccgacaccaucuggaacgucuccuacuccggcaccuccaaggccugcuccgacuccuucuaccgcuccaugcgcuggcucacccagaaggacaacgccuaccccauccaggacgcccaguacaccaacaaccaggagaagaacauccucuucauguggggcaucaaccacccccccaccgacaccgcccagaccaaccucuacacccgcaccgacaccaccaccuccgucgccaccgaggagaucaaccgcaccuucaagccccucaucggcccccgcccccucguccacggccucaugggccgcaucaacuacuacugguccguccucaagcccggccagacccuccgcaucaaguccaacggcaaccucaucgcccccugguacggccacauccucuccggcaagucccacggccgcauccucaagaccgaccucaagcgcggcaacugcaccguccagugccagaccgagaagggcggccucaacaccacccuccccuuccagaacgucuccaaguacgccuucggcaacugcuccaaguacaucggcaucaagucccucaagcucgccgucggccuccgcaacguccccucccgcuccucccgcggccucuucggcgccaucgccggcuucaucgagggcggcugguccggccucgucgccggcugguacggcuuccagcacuccaacgaccagggcgucggcauggccgccgaccgcgacuccacccagaaggccaucgacaagaucaccuccaaggucaacaacaucgucgacaagaugaacaagcaguacgagaucaucgaccacgaguucuccgaggucgagacccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgagcucuaccacaagugcgacgaccagugcauggagaccauccgcaacggcaccuacaaccgccgcaaguaccaggaggaguccaagcucgagaagcagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 104027 - RNA, 1701 nt, Artificial Sequence; identical to SEQ ID NO: 98494
  derived and/or modified sequence opt2 from hemagglutinin__InfluenzaA__AIJ10728

SEQ ID NO: 104028 - RNA, 1701 nt, Artificial Sequence
  derived and/or modified sequence opt2 from hemagglutinin__InfluenzaA__AIJ10729
augaagaccaucaucgcccucuccuacauccucugccucgucuucgcccagaagcuccccggccacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagaccaagggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104029 - RNA, 1701 nt, Artificial Sequence; identical to SEQ ID NO: 98494
  derived and/or modified sequence opt2 from hemagglutinin__InfluenzaA__AIJ10730

SEQ ID NO: 104030 - RNA, 1701 nt, Artificial Sequence; identical to SEQ ID NO: 98494
  derived and/or modified sequence opt2 from hemagglutinin__InfluenzaA__AIJ10731

SEQ ID NO: 104031 - RNA, 1701 nt, Artificial Sequence
  derived and/or modified sequence opt2 from hemagglutinin__InfluenzaA__AIJ10732
augaagaccaucaucgcccucuccuacauccucugccucgucuucgcccaggagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuuccgcuaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104032 - RNA, 1701 nt, Artificial Sequence
  derived and/or modified sequence opt2 from hemagglutinin__InfluenzaA__AIJ10733
augaagaccaucaucgcccucuccuacauccucugccucgucuucgcccaggagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuuccgcuaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104033 - RNA, 1701 nt, Artificial Sequence
  derived and/or modified sequence opt2 from hemagglutinin__InfluenzaA__AIJ10734
augaagaccaucaucgcccucuccuacauccucugccucgucuucgcccagaagcuccccgagaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccaccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104034 - RNA, 1701 nt, Artificial Sequence
  derived and/or modified sequence opt2 from hemagglutinin__InfluenzaA__AIJ10735
augaagaccaucaucgcccucuccuacauccucugccucaucuucgcccagaagcuccccgagaacgacaacuccaccgccacccucugccucggccaccacgccguccccaacggcaccaucgucaagaccaucaccaacgaccagaucgaggucaccaacgccaccgagcucguccaguccuccuccaccggcgagaucugcaacuccccccaccagauccucgacggcgagaacugcacccucaucgacgcccuccucggcgacccccagugcgacggcuuccagaacaagaagugggaccucuucgucgagcgcuccaaggcccacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcgucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccaccugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaagggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104035 - RNA, 1701 nt, Artificial Sequence
  derived and/or modified sequence opt2 from hemagglutinin__InfluenzaA__AIJ10736
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccaccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104036 - RNA, 1701 nt, Artificial Sequence
  derived and/or modified sequence opt2 from hemagglutinin__InfluenzaA__AIJ10737
augaagaccaucaucgcccucuccuacauccucugccucgucgucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104037 - RNA, 1701 nt, Artificial Sequence
  derived and/or modified sequence opt2 from hemagglutinin__InfluenzaA__AIJ10738
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcacuucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104038 - RNA, 1701 nt, Artificial Sequence; identical to SEQ ID NO: 100965
  derived and/or modified sequence opt2 from hemagglutinin__InfluenzaA__AIJ10740

SEQ ID NO: 104039 - RNA, 1701 nt, Artificial Sequence; identical to SEQ ID NO: 100965
  derived and/or modified sequence opt2 from hemagglutinin__InfluenzaA__AIJ10741

SEQ ID NO: 104040 - RNA, 1701 nt, Artificial Sequence
  derived and/or modified sequence opt2 from hemagglutinin__InfluenzaA__AIJ10742
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucgccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104041 - RNA, 1701 nt, Artificial Sequence
  derived and/or modified sequence opt2 from hemagglutinin__InfluenzaA__AIJ10743
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaucaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104042 - RNA, 1701 nt, Artificial Sequence
  derived and/or modified sequence opt2 from hemagglutinin__InfluenzaA__AIJ10744
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcagcgcacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104043 - RNA, 1701 nt, Artificial Sequence; identical to SEQ ID NO: 101506
  derived and/or modified sequence opt2 from hemagglutinin__InfluenzaA__AIJ10745

SEQ ID NO: 104044 - RNA, 1701 nt, Artificial Sequence
  derived and/or modified sequence opt2 from hemagglutinin__InfluenzaA__AIJ10747
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacgacuuccagaacaagaagugggaccucuucgucgagcgcuccaaggccuacuccaacugcuaccccuacgacguccccgacuacgccucccuccgcucccucgucgccuccuccggcacccucgaguucaacaacgagaacuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104045 - RNA, 1701 nt, Artificial Sequence; identical to SEQ ID NO: 104044
  derived and/or modified sequence opt2 from hemagglutinin__InfluenzaA__AIJ10748

SEQ ID NO: 104046 - RNA, 1701 nt, Artificial Sequence
  derived and/or modified sequence opt2 from hemagglutinin__InfluenzaA__AIJ10750
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucauccgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104047 - RNA, 1701 nt, Artificial Sequence
  derived and/or modified sequence opt2 from hemagglutinin__InfluenzaA__AIJ10752
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccauguccugcuuccuccucugcgucgcccuccucggcuucaucaugugggccugccagaagggcaacauccgcugcaacaucugcaucuga

SEQ ID NO: 104048 - RNA, 1701 nt, Artificial Sequence
  derived and/or modified sequence opt2 from hemagglutinin__InfluenzaA__AIJ10753
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccuccugcauccgcggcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104049 - RNA, 1701 nt, Artificial Sequence; identical to SEQ ID NO: 101506
  derived and/or modified sequence opt2 from hemagglutinin__InfluenzaA__AIJ10754

SEQ ID NO: 104050 - RNA, 1701 nt, Artificial Sequence
  derived and/or modified sequence opt2 from hemagglutinin__InfluenzaA__AIJ10755
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaguccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104051 - RNA, 1701 nt, Artificial Sequence; identical to SEQ ID NO: 101506
  derived and/or modified sequence opt2 from hemagglutinin__InfluenzaA__AIJ10756

SEQ ID NO: 104052 - RNA, 1701 nt, Artificial Sequence
  derived and/or modified sequence opt2 from hemagglutinin__InfluenzaA__AIJ10757
augaagaccaucaucgcccucuccuacauccucugccucgucaucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 104053 - RNA, 1701 nt, Artificial Sequence
  derived and/or modified sequence opt2 from hemagglutinin__InfluenzaA__AIJ10758
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104054 - RNA, 1701 nt, Artificial Sequence; identical to SEQ ID NO: 101506
  derived and/or modified sequence opt2 from hemagglutinin__InfluenzaA__AIJ10759

SEQ ID NO: 104055 - RNA, 1701 nt, Artificial Sequence
  derived and/or modified sequence opt2 from hemagglutinin__InfluenzaA__AIJ10760
augaagaccaucaucgcccucuccuacauccucugccucgucaucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104056 - RNA, 1701 nt, Artificial Sequence
  derived and/or modified sequence opt2 from hemagglutinin__InfluenzaA__AIJ10761
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcaacgaggcccucaacaagcgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 104057 - RNA, 1701 nt, Artificial Sequence; identical to SEQ ID NO: 103404
  derived and/or modified sequence opt2 from hemagglutinin__InfluenzaA__AIJ10762

SEQ ID NO: 104058 - RNA, 1701 nt, Artificial Sequence; identical to SEQ ID NO: 103404
  derived and/or modified sequence opt2 from hemagglutinin__InfluenzaA__AIJ10763

SEQ ID NO: 104059 - RNA, 1701 nt, Artificial Sequence; identical to SEQ ID NO: 103404
  derived and/or modified sequence opt2 from hemagglutinin__InfluenzaA__AIJ10764

SEQ ID NO: 104060 - RNA, 1701 nt, Artificial Sequence; identical to SEQ ID NO: 103404
  derived and/or modified sequence opt2 from hemagglutinin__InfluenzaA__AIJ10765

SEQ ID NO: 104061 - RNA, 1701 nt, Artificial Sequence; identical to SEQ ID NO: 103404
  derived and/or modified sequence opt2 from hemagglutinin__InfluenzaA__AIJ10766

SEQ ID NO: 104062 - RNA, 1701 nt, Artificial Sequence; identical to SEQ ID NO: 103404
  derived and/or modified sequence opt2 from hemagglutinin__InfluenzaA__AIJ10767

SEQ ID NO: 104063 - RNA, 1701 nt, Artificial Sequence
  derived and/or modified sequence opt2 from hemagglutinin__InfluenzaA__AIJ10768
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacauccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 104064 - RNA, 1701 nt, Artificial Sequence
  derived and/or modified sequence opt2 from hemagglutinin__InfluenzaA__AIJ10769
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccaguccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 104065 - RNA, 1701 nt, Artificial Sequence; identical to SEQ ID NO: 103404
  derived and/or modified sequence opt2 from hemagglutinin__InfluenzaA__AIJ10770

SEQ ID NO: 104066 - RNA, 1701 nt, Artificial Sequence; identical to SEQ ID NO: 103404
  derived and/or modified sequence opt2 from hemagglutinin__InfluenzaA__AIJ10771

SEQ ID NO: 104067 - RNA, 1701 nt, Artificial Sequence; identical to SEQ ID NO: 103404
  derived and/or modified sequence opt2 from hemagglutinin__InfluenzaA__AIJ10772

SEQ ID NO: 104068 - RNA, 1701 nt, Artificial Sequence; identical to SEQ ID NO: 103404
  derived and/or modified sequence opt2 from hemagglutinin__InfluenzaA__AIJ10773

SEQ ID NO: 104069 - RNA, 1701 nt, Artificial Sequence
  derived and/or modified sequence opt2 from hemagglutinin__InfluenzaA__AIJ10774
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcaacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaguccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 104070 - RNA, 1701 nt, Artificial Sequence
  derived and/or modified sequence opt2 from hemagglutinin__InfluenzaA__AIJ10776
augaagaccaucaucgcccucuccugcauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagauguccaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 104071 - RNA, 1701 nt, Artificial Sequence; identical to SEQ ID NO: 103404
  derived and/or modified sequence opt2 from hemagglutinin__InfluenzaA__AIJ10777

SEQ ID NO: 104072 - RNA, 1701 nt, Artificial Sequence; identical to SEQ ID NO: 103404
  derived and/or modified sequence opt2 from hemagglutinin__InfluenzaA__AIJ10778

SEQ ID NO: 104073 - RNA, 1701 nt, Artificial Sequence
  derived and/or modified sequence opt2 from hemagglutinin__InfluenzaA__AIJ10780
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacuccuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccacuccaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggacaucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104074 - RNA, 1701 nt, Artificial Sequence; identical to SEQ ID NO: 103404
  derived and/or modified sequence opt2 from hemagglutinin__InfluenzaA__AIJ10781

SEQ ID NO: 104075 - RNA, 1701 nt, Artificial Sequence; identical to SEQ ID NO: 103404
  derived and/or modified sequence opt2 from hemagglutinin__InfluenzaA__AIJ10782

SEQ ID NO: 104076 - RNA, 1701 nt, Artificial Sequence
  derived and/or modified sequence opt2 from hemagglutinin__InfluenzaA__AIJ10783
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggucggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugaaggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104077 - RNA, 1701 nt, Artificial Sequence; identical to SEQ ID NO: 104076
  derived and/or modified sequence opt2 from hemagglutinin__InfluenzaA__AIJ10784

SEQ ID NO: 104078 - RNA, 1701 nt, Artificial Sequence
  derived and/or modified sequence opt2 from hemagglutinin__InfluenzaA__AIJ10785
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcaacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugauggacggcugguacggcuuccgccaccagaacuccgagggccgcggccaggccgccgaccucaaguccacccaguccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104079 - RNA, 1701 nt, Artificial Sequence; identical to SEQ ID NO: 104076
  derived and/or modified sequence opt2 from hemagglutinin__InfluenzaA__AIJ10786

SEQ ID NO: 104080 - RNA, 1701 nt, Artificial Sequence
  derived and/or modified sequence opt2 from hemagglutinin__InfluenzaA__AIJ10787
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggucggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcaugaaggacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccgcaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104081 - RNA, 1701 nt, Artificial Sequence; identical to SEQ ID NO: 104078
  derived and/or modified sequence opt2 from hemagglutinin__InfluenzaA__AIJ10788

SEQ ID NO: 104082 - RNA, 1701 nt, Artificial Sequence; identical to SEQ ID NO: 104078
  derived and/or modified sequence opt2 from hemagglutinin__InfluenzaA__AIJ10789

SEQ ID NO: 104083 - RNA, 1701 nt, Artificial Sequence; identical to SEQ ID NO: 104076
  derived and/or modified sequence opt2 from hemagglutinin__InfluenzaA__AIJ10790

SEQ ID NO: 104084 - RNA, 1701 nt, Artificial Sequence; identical to SEQ ID NO: 103404
  derived and/or modified sequence opt2 from hemagglutinin__InfluenzaA__AIJ10791

SEQ ID NO: 104085 - RNA, 1701 nt, Artificial Sequence
  derived and/or modified sequence opt2 from hemagglutinin__InfluenzaA__AIJ10792
augaagaccaucaucgcccucuccuacauccucugccucgucuucgcccagaagcuccccggcgacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 104086 - RNA, 1701 nt, Artificial Sequence; identical to SEQ ID NO: 101395
  derived and/or modified sequence opt2 from hemagglutinin__InfluenzaA__AIJ29347

SEQ ID NO: 104087 - RNA, 1701 nt, Artificial Sequence
  derived and/or modified sequence opt2 from hemagglutinin__InfluenzaA__AIJ29349
augaagaccaucaucgcccucuccuacauccucugccucgucuucgcccagaaguuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104088 - RNA, 1701 nt, Artificial Sequence
  derived and/or modified sequence opt2 from hemagglutinin__InfluenzaA__AIJ29351
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugccuccuccucugcgucgcccuccucggcuucaucaugugggccugccagaagggcaacauccgcugcaacaucugcaucuga

SEQ ID NO: 104089 - RNA, 1701 nt, Artificial Sequence; identical to SEQ ID NO: 100992
  derived and/or modified sequence opt2 from hemagglutinin__InfluenzaA__AIJ29353

SEQ ID NO: 104090 - RNA, 1701 nt, Artificial Sequence
  derived and/or modified sequence opt2 from hemagglutinin__InfluenzaA__AIJ29355
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcucccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacaaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104091 - RNA, 1701 nt, Artificial Sequence; identical to SEQ ID NO: 100586
  derived and/or modified sequence opt2 from hemagglutinin__InfluenzaA__AIJ29357

SEQ ID NO: 104092 - RNA, 1701 nt, Artificial Sequence
  derived and/or modified sequence opt2 from hemagglutinin__InfluenzaA__AIJ29359
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggccaucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104093 - RNA, 1701 nt, Artificial Sequence
  derived and/or modified sequence opt2 from hemagglutinin__InfluenzaA__AIJ29361
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgucucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104094 - RNA, 1701 nt, Artificial Sequence; identical to SEQ ID NO: 101552
  derived and/or modified sequence opt2 from hemagglutinin__InfluenzaA__AIL93623

SEQ ID NO: 104095 - RNA, 1701 nt, Artificial Sequence
  derived and/or modified sequence opt2 from hemagglutinin__InfluenzaA__AIL93634
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcaacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104096 - RNA, 1701 nt, Artificial Sequence
  derived and/or modified sequence opt2 from hemagglutinin__InfluenzaA__AIL93645
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuuccgcuaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104097 - RNA, 1701 nt, Artificial Sequence; identical to SEQ ID NO: 101506
  derived and/or modified sequence opt2 from hemagglutinin__InfluenzaA__AIL93657

SEQ ID NO: 104098 - RNA, 1701 nt, Artificial Sequence; identical to SEQ ID NO: 101506
  derived and/or modified sequence opt2 from hemagglutinin__InfluenzaA__AIL93669

SEQ ID NO: 104099 - RNA, 1701 nt, Artificial Sequence
  derived and/or modified sequence opt2 from hemagglutinin__InfluenzaA__AIL93681
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcuccgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104100 - RNA, 1701 nt, Artificial Sequence; identical to SEQ ID NO: 104096
  derived and/or modified sequence opt2 from hemagglutinin__InfluenzaA__AIL93692

SEQ ID NO: 104101 - RNA, 1701 nt, Artificial Sequence; identical to SEQ ID NO: 104096
  derived and/or modified sequence opt2 from hemagglutinin__InfluenzaA__AIL93716

SEQ ID NO: 104102 - RNA, 1701 nt, Artificial Sequence; identical to SEQ ID NO: 101506
  derived and/or modified sequence opt2 from hemagglutinin__InfluenzaA__AIL93728

SEQ ID NO: 104103 - RNA, 1701 nt, Artificial Sequence; identical to SEQ ID NO: 101506
  derived and/or modified sequence opt2 from hemagglutinin__InfluenzaA__AIL93740

SEQ ID NO: 104104 - RNA, 1701 nt, Artificial Sequence
  derived and/or modified sequence opt2 from hemagglutinin__InfluenzaA__AIL93752
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgaccgcccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagaagucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104105 - RNA, 1701 nt, Artificial Sequence
  derived and/or modified sequence opt2 from hemagglutinin__InfluenzaA__AIL93764
augaagaccaucaucgcccucuccuacauccucugccucgucuucacccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacgagaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104106 - RNA, 1701 nt, Artificial Sequence; identical to SEQ ID NO: 101506
  derived and/or modified sequence opt2 from hemagglutinin__InfluenzaA__AIL93776

SEQ ID NO: 104107 - RNA, 1701 nt, Artificial Sequence; identical to SEQ ID NO: 101506
  derived and/or modified sequence opt2 from hemagglutinin__InfluenzaA__AIL93788

SEQ ID NO: 104108 - RNA, 1701 nt, Artificial Sequence; identical to SEQ ID NO: 101506
  derived and/or modified sequence opt2 from hemagglutinin__InfluenzaA__AIL93812

SEQ ID NO: 104109 - RNA, 1701 nt, Artificial Sequence; identical to SEQ ID NO: 101506
  derived and/or modified sequence opt2 from hemagglutinin__InfluenzaA__AIL93824

SEQ ID NO: 104110 - RNA, 1701 nt, Artificial Sequence; identical to SEQ ID NO: 104099
  derived and/or modified sequence opt2 from hemagglutinin__InfluenzaA__AIL93836

SEQ ID NO: 104111 - RNA, 1701 nt, Artificial Sequence
  derived and/or modified sequence opt2 from hemagglutinin__InfluenzaA__AIL93847
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcuccgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucugcuucuggaugugcuccaacggcucccuccagugccgcaucugcaucuga

SEQ ID NO: 104112 - RNA, 1701 nt, Artificial Sequence; identical to SEQ ID NO: 104096
  derived and/or modified sequence opt2 from hemagglutinin__InfluenzaA__AIL93858

SEQ ID NO: 104113 - RNA, 1701 nt, Artificial Sequence; identical to SEQ ID NO: 101506
  derived and/or modified sequence opt2 from hemagglutinin__InfluenzaA__AIL93870

SEQ ID NO: 104114 - RNA, 1701 nt, Artificial Sequence
  derived and/or modified sequence opt2 from hemagglutinin__InfluenzaA__AIL93882
augaagaccaucaucgcccucuccuacauccucugccucgucuucgcccagaagccccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104115 - RNA, 1701 nt, Artificial Sequence; identical to SEQ ID NO: 101506
  derived and/or modified sequence opt2 from hemagglutinin__InfluenzaA__AIL93894

SEQ ID NO: 104116 - RNA, 1701 nt, Artificial Sequence
  derived and/or modified sequence opt2 from hemagglutinin__InfluenzaA__AIL93906
augaaggccauccucgucguccuccucuacaccuucgccaccgccaacgccgacacccucugcaucggcuaccacgccaacaacuccaccgacaccgucgacaccguccucgagaagaacgucaccgucacccacuccaucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagauguuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccuccaaguacuccaagaaguucaagcccgagaucgccauccgccccaagguccgcgaccaggagggccgcaugaacuacuacuggacccucaucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104117 - RNA, 1701 nt, Artificial Sequence
  derived and/or modified sequence opt2 from hemagglutinin__InfluenzaA__AIL93917
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgaccgcccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagaugcgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104118 - RNA, 1701 nt, Artificial Sequence; identical to SEQ ID NO: 101552
  derived and/or modified sequence opt2 from hemagglutinin__InfluenzaA__AIL93929

SEQ ID NO: 104119 - RNA, 1701 nt, Artificial Sequence
  derived and/or modified sequence opt2 from hemagglutinin__InfluenzaA__AIL93940
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucuccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104120 - RNA, 1701 nt, Artificial Sequence; identical to SEQ ID NO: 101506
  derived and/or modified sequence opt2 from hemagglutinin__InfluenzaA__AIL93951

SEQ ID NO: 104121 - RNA, 1701 nt, Artificial Sequence; identical to SEQ ID NO: 101506
  derived and/or modified sequence opt2 from hemagglutinin__InfluenzaA__AIL93963

SEQ ID NO: 104122 - RNA, 1701 nt, Artificial Sequence; identical to SEQ ID NO: 101370
  derived and/or modified sequence opt2 from hemagglutinin__InfluenzaA__AIL93975

SEQ ID NO: 104123 - RNA, 1701 nt, Artificial Sequence; identical to SEQ ID NO: 104099
  derived and/or modified sequence opt2 from hemagglutinin__InfluenzaA__AIL93987

SEQ ID NO: 104124 - RNA, 1701 nt, Artificial Sequence; identical to SEQ ID NO: 101506
  derived and/or modified sequence opt2 from hemagglutinin__InfluenzaA__AIL93998

SEQ ID NO: 104125 - RNA, 1701 nt, Artificial Sequence; identical to SEQ ID NO: 104096
  derived and/or modified sequence opt2 from hemagglutinin__InfluenzaA__AIL94010

SEQ ID NO: 104126 - RNA, 1701 nt, Artificial Sequence; identical to SEQ ID NO: 104096
  derived and/or modified sequence opt2 from hemagglutinin__InfluenzaA__AIL94022

SEQ ID NO: 104127 - RNA, 1701 nt, Artificial Sequence
  derived and/or modified sequence opt2 from hemagglutinin__InfluenzaA__AIL94046
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgaccgcccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104128 - RNA, 1701 nt, Artificial Sequence
  derived and/or modified sequence opt2 from hemagglutinin__InfluenzaA__AIL94058
augaaggccauccucgucguccuccucuacaccuucgcccccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccaucgagcgcuccgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104129 - RNA, 1701 nt, Artificial Sequence; identical to SEQ ID NO: 104099
  derived and/or modified sequence opt2 from hemagglutinin__InfluenzaA__AIL94069

SEQ ID NO: 104130 - RNA, 1701 nt, Artificial Sequence; identical to SEQ ID NO: 101552
  derived and/or modified sequence opt2 from hemagglutinin__InfluenzaA__AIL94080

SEQ ID NO: 104131 - RNA, 1701 nt, Artificial Sequence; identical to SEQ ID NO: 104096
  derived and/or modified sequence opt2 from hemagglutinin__InfluenzaA__AIL94235

SEQ ID NO: 104132 - RNA, 1701 nt, Artificial Sequence; identical to SEQ ID NO: 101552
  derived and/or modified sequence opt2 from hemagglutinin__InfluenzaA__AIL94247

SEQ ID NO: 104133 - RNA, 1701 nt, Artificial Sequence
  derived and/or modified sequence opt2 from hemagglutinin__InfluenzaA__AIL94258
augaagaccaucaucgcccucuccuacauccucugccucgucuucacccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104134 - RNA, 1701 nt, Artificial Sequence
  derived and/or modified sequence opt2 from hemagglutinin__InfluenzaA__AIL94270
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104135 - RNA, 1701 nt, Artificial Sequence; identical to SEQ ID NO: 101506
  derived and/or modified sequence opt2 from hemagglutinin__InfluenzaA__AIL94282

SEQ ID NO: 104136 - RNA, 1701 nt, Artificial Sequence; identical to SEQ ID NO: 101506
  derived and/or modified sequence opt2 from hemagglutinin__InfluenzaA__AIL94294

SEQ ID NO: 104137 - RNA, 1701 nt, Artificial Sequence
  derived and/or modified sequence opt2 from hemagglutinin__InfluenzaA__AIL94306
augaagaccaucaccgcccucuccuacauccucugccucgccuucgcccagaagccccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104138 - RNA, 1701 nt, Artificial Sequence
  derived and/or modified sequence opt2 from hemagglutinin__InfluenzaA__AIL94318
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccucaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104139 - RNA, 1701 nt, Artificial Sequence; identical to SEQ ID NO: 101370
  derived and/or modified sequence opt2 from hemagglutinin__InfluenzaA__AIL94330

SEQ ID NO: 104140 - RNA, 1701 nt, Artificial Sequence; identical to SEQ ID NO: 101552
  derived and/or modified sequence opt2 from hemagglutinin__InfluenzaA__AIL94354

SEQ ID NO: 104141 - RNA, 1701 nt, Artificial Sequence; identical to SEQ ID NO: 101506
  derived and/or modified sequence opt2 from hemagglutinin__InfluenzaA__AIL94365

SEQ ID NO: 104142 - RNA, 1701 nt, Artificial Sequence
  derived and/or modified sequence opt2 from hemagglutinin__InfluenzaA__AIL94377
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccacugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104143 - RNA, 1701 nt, Artificial Sequence
  derived and/or modified sequence opt2 from hemagglutinin__InfluenzaA__AIL94389
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucauccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104144 - RNA, 1701 nt, Artificial Sequence; identical to SEQ ID NO: 101506
  derived and/or modified sequence opt2 from hemagglutinin__InfluenzaA__AIL94411

SEQ ID NO: 104145 - RNA, 1701 nt, Artificial Sequence; identical to SEQ ID NO: 101506
  derived and/or modified sequence opt2 from hemagglutinin__InfluenzaA__AIL94423

SEQ ID NO: 104146 - RNA, 1701 nt, Artificial Sequence; identical to SEQ ID NO: 104099
  derived and/or modified sequence opt2 from hemagglutinin__InfluenzaA__AIL94435

SEQ ID NO: 104147 - RNA, 1701 nt, Artificial Sequence; identical to SEQ ID NO: 101506
  derived and/or modified sequence opt2 from hemagglutinin__InfluenzaA__AIL94446

SEQ ID NO: 104148 - RNA, 1701 nt, Artificial Sequence; identical to SEQ ID NO: 101506
  derived and/or modified sequence opt2 from hemagglutinin__InfluenzaA__AIL94458

SEQ ID NO: 104149 - RNA, 1701 nt, Artificial Sequence
  derived and/or modified sequence opt2 from hemagglutinin__InfluenzaA__AIL94470
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccgcccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104150 - RNA, 1701 nt, Artificial Sequence
  derived and/or modified sequence opt2 from hemagglutinin__InfluenzaA__AIL94481
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggaucaucuggaucuccuucgccaucuccugcuuccuccucugcgucgcccuccucggcuucaucaugugggccugccagaagggcaacauccgcugcaacaucugcaucuga

SEQ ID NO: 104151 - RNA, 1701 nt, Artificial Sequence
  derived and/or modified sequence opt2 from hemagglutinin__InfluenzaA__AIL94493
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagaagaacgccggcuccggcaucaucaucuccgacacccccguccacgacugcaacaccaccugccagacccccgagggcgccaucaacaccuccuuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104152 - RNA, 1701 nt, Artificial Sequence; identical to SEQ ID NO: 104099
  derived and/or modified sequence opt2 from hemagglutinin__InfluenzaA__AIL94504

SEQ ID NO: 104153 - RNA, 1701 nt, Artificial Sequence; identical to SEQ ID NO: 101506
  derived and/or modified sequence opt2 from hemagglutinin__InfluenzaA__AIL94515

SEQ ID NO: 104154 - RNA, 1701 nt, Artificial Sequence; identical to SEQ ID NO: 101506
  derived and/or modified sequence opt2 from hemagglutinin__InfluenzaA__AIL94527

SEQ ID NO: 104155 - RNA, 1701 nt, Artificial Sequence
  derived and/or modified sequence opt2 from hemagglutinin__InfluenzaA__AIL94539
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccgcccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggaggucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104156 - RNA, 1701 nt, Artificial Sequence; identical to SEQ ID NO: 104099
  derived and/or modified sequence opt2 from hemagglutinin__InfluenzaA__AIL94550

SEQ ID NO: 104157 - RNA, 1701 nt, Artificial Sequence
  derived and/or modified sequence opt2 from hemagglutinin__InfluenzaA__AIL94561
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagcgcggcaacauccgcugcaacaucugcaucuga

SEQ ID NO: 104158 - RNA, 1701 nt, Artificial Sequence
  derived and/or modified sequence opt2 from hemagglutinin__InfluenzaA__AIL94573
augaaggccauccucgucguccuccucuacaccuucgccaccgccaacgccgacacccucugcaucggcuaccacgccaacaacuccaccgacaccgucgacaccguccucgagaagaacgucaucgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcgucuaccagauccucgccaucuacuccaccgucgccuccucccucguccucgucgucucccucggcgccaucuccuucuggaugugcuccaacggcucccuccagugccgcaucugcaucuga

SEQ ID NO: 104159 - RNA, 1701 nt, Artificial Sequence
  derived and/or modified sequence opt2 from hemagglutinin__InfluenzaA__AIL94584
augaaggccauccucgucguccuccucuacaccuucgccaccgccaacgccgacacccucugcaucggcuaccacgccaacaacuccaccgacaccgucgacaccguccucgagaagaacaucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggccgcugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104160 - RNA, 1701 nt, Artificial Sequence; identical to SEQ ID NO: 103567
  derived and/or modified sequence opt2 from hemagglutinin__InfluenzaA__AIL94595

SEQ ID NO: 104161 - RNA, 1701 nt, Artificial Sequence; identical to SEQ ID NO: 101506
  derived and/or modified sequence opt2 from hemagglutinin__InfluenzaA__AIL94606

SEQ ID NO: 104162 - RNA, 1701 nt, Artificial Sequence; identical to SEQ ID NO: 101552
  derived and/or modified sequence opt2 from hemagglutinin__InfluenzaA__AIL94618

SEQ ID NO: 104163 - RNA, 1701 nt, Artificial Sequence; identical to SEQ ID NO: 104099
  derived and/or modified sequence opt2 from hemagglutinin__InfluenzaA__AIL94629

SEQ ID NO: 104164 - RNA, 1701 nt, Artificial Sequence; identical to SEQ ID NO: 101506
  derived and/or modified sequence opt2 from hemagglutinin__InfluenzaA__AIL94640

SEQ ID NO: 104165 - RNA, 1701 nt, Artificial Sequence
  derived and/or modified sequence opt2 from hemagglutinin__InfluenzaA__AIL94652
augaaggccauccucgucguccuccucuacaccuucgccaccgccaacgccgacacccucugcaucggcuaccacgccaacaacuccaccgacaccgucgacaccguccucgagaagaacgucaccgucacccacuccaucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagauguuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccaccgccgaccagcagucccucuaccagaacgccgacgccuacgucuucgucggcaccuccaaguacuccaagaaguucaagcccgagaucgccauccgccccaagguccgcgaccaggagggccgcaugaacuacuacuggacccucaucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucgaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104166 - RNA, 1701 nt, Artificial Sequence; identical to SEQ ID NO: 101552
  derived and/or modified sequence opt2 from hemagglutinin__InfluenzaA__AIL94663

SEQ ID NO: 104167 - RNA, 1701 nt, Artificial Sequence; identical to SEQ ID NO: 101552
  derived and/or modified sequence opt2 from hemagglutinin__InfluenzaA__AIL94674

SEQ ID NO: 104168 - RNA, 1701 nt, Artificial Sequence; identical to SEQ ID NO: 101506
  derived and/or modified sequence opt2 from hemagglutinin__InfluenzaA__AIL94697

SEQ ID NO: 104169 - RNA, 1701 nt, Artificial Sequence; identical to SEQ ID NO: 101552
  derived and/or modified sequence opt2 from hemagglutinin__InfluenzaA__AIL94709

SEQ ID NO: 104170 - RNA, 1701 nt, Artificial Sequence; identical to SEQ ID NO: 101552
  derived and/or modified sequence opt2 from hemagglutinin__InfluenzaA__AIL94720

SEQ ID NO: 104171 - RNA, 1701 nt, Artificial Sequence; identical to SEQ ID NO: 101506
  derived and/or modified sequence opt2 from hemagglutinin__InfluenzaA__AIL94731

SEQ ID NO: 104172 - RNA, 1701 nt, Artificial Sequence; identical to SEQ ID NO: 104099
  derived and/or modified sequence opt2 from hemagglutinin__InfluenzaA__AIL94743

SEQ ID NO: 104173 - RNA, 1701 nt, Artificial Sequence
  derived and/or modified sequence opt2 from hemagglutinin__InfluenzaA__AIL94754
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucauccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgccaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104174 - RNA, 1701 nt, Artificial Sequence; identical to SEQ ID NO: 104127
  derived and/or modified sequence opt2 from hemagglutinin__InfluenzaA__AIL94765

SEQ ID NO: 104175 - RNA, 1701 nt, Artificial Sequence; identical to SEQ ID NO: 101506
  derived and/or modified sequence opt2 from hemagglutinin__InfluenzaA__AIL94777

SEQ ID NO: 104176 - RNA, 1701 nt, Artificial Sequence; identical to SEQ ID NO: 103414
  derived and/or modified sequence opt2 from hemagglutinin__InfluenzaA__AIL94789

SEQ ID NO: 104177 - RNA, 1701 nt, Artificial Sequence; identical to SEQ ID NO: 101552
  derived and/or modified sequence opt2 from hemagglutinin__InfluenzaA__AIL94800

SEQ ID NO: 104178 - RNA, 1701 nt, Artificial Sequence
  derived and/or modified sequence opt2 from hemagglutinin__InfluenzaA__AIL94811
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuccuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacaacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104179 - RNA, 1701 nt, Artificial Sequence; identical to SEQ ID NO: 101370
  derived and/or modified sequence opt2 from hemagglutinin__InfluenzaA__AIL94823

SEQ ID NO: 104180 - RNA, 1701 nt, Artificial Sequence
  derived and/or modified sequence opt2 from hemagglutinin__InfluenzaA__AIL94835
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccgcaucgaggucaccaacgccaccgagcucguccagaacuacuccaucggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacugggccggcgucacccagaacggcaccuccuccgccugcauccgcggcuccaacuccuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaguccuccggccgcaucaccgucuccaccaagcgcucccagcaggccgucauccccaacaucggcucccgcccccgcauccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaaguccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104181 - RNA, 1701 nt, Artificial Sequence
  derived and/or modified sequence opt2 from hemagglutinin__InfluenzaA__AIL94847
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaaguucaaguaccccgcccucaacgucaccaugcccaacgacgagaaguucgacaagcucuacaucuggggcguccaccaccccggcaccgacaacgaccagaucuuccucuacgcccaggccuccggccgcaucaccgucuccaccaagcgcucccagcagaccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggcaucggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaagaucuaccacaagugcgacaacgccugcaucggcuccauccgcaacggcaccuacgaccacgacgucuaccgcgacgaggcccucaacaaccgcuuccagaucaagggcgucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104182 - RNA, 1701 nt, Artificial Sequence; identical to SEQ ID NO: 97045
  derived and/or modified sequence opt2 from hemagglutinin__InfluenzaA__AIL94859

SEQ ID NO: 104183 - RNA, 1701 nt, Artificial Sequence
  derived and/or modified sequence opt2 from hemagglutinin__InfluenzaA__AIL94871
augaagaccaucaucgcccucuccuacauccucugccucgucuucgcccagaagcuccccggcaacgacaacuccaccgccacccucugccucggccaccacgccguccccaacggcaccaucgucaagaccaucaccaacgaccagaucgaggucaccaacgccaccgagcucguccaguccuccuccaccggcgagaucugcgacuccccccaccagauccucgacggcgagaacugcacccucaucgacgcccuccucggcgacccccagugcgacggcuuccagaacaagaagugggaccucuucgucgagcgcuccaaggccuacuccaacugcuaccccuacgacguccccgacuacgccucccuccgcucccucgucgccuccuccggcacccucgaguucaacaacgaguccuucaacuggaccggcgucacccagaacggcaccuccuccgccugcauccgccgcuccaacaacuccuucuucucccgccucaacuggcucacccaccucaacuucaaguaccccgcccucaacgucaccaugcccaacaacgagcaguucgacaagcucuacaucuggggcguccaccaccccggcaccgacaaggaccagaucuuccucuacgcccaggccuccggccgcaucaccgucuccaccaagcgcucccagcaggccgucauccccaacaucggcucccgcccccgcguccgcaacauccccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaagugcaacuccgagugcaucacccccaacggcuccauccccaacgacaagcccuuccagaacgucaaccgcaucaccuacggcgccugcccccgcuacgucaagcaguccacccucaagcucgccaccggcaugcgcaacguccccgagaagcagacccgcggcaucuucggcgccaucgccggcuucaucgagaacggcugggagggcauggucgacggcugguacggcuuccgccaccagaacuccgagggccgcggccaggccgccgaccucaaguccacccaggccgccaucgaccagaucaacggcaagcucaaccgccucaucggcaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagaagaccaagaagcagcuccgcgagaacgccgaggacaugggcaacggcugcuucaccaucuaccacaagugcgacaacgccugcaucggcuccauccgcaacggcaccuacgaccacaacgucuaccgcgacgaggcccucaacaaccgcuuccagaucaagggcaucgagcucaaguccggcuacaaggacuggauccucuggaucuccuucgccaucuccugcuuccuccucugcgucgcccuccucggcuucaucaugugggccugccagaagggcaacauccgcugcaacaucugcaucuga

SEQ ID NO: 104184 - RNA, 1701 nt, Artificial Sequence; identical to SEQ ID NO: 103592
  derived and/or modified sequence opt2 from hemagglutinin__InfluenzaA__AIL94883

SEQ ID NO: 104185 - RNA, 1701 nt, Artificial Sequence; identical to SEQ ID NO: 103577
  derived and/or modified sequence opt2 from hemagglutinin__InfluenzaA__AIL94894

SEQ ID NO: 104186 - RNA, 1701 nt, Artificial Sequence; identical to SEQ ID NO: 101370
  derived and/or modified sequence opt2 from hemagglutinin__InfluenzaA__AIL94906

SEQ ID NO: 104187 - RNA, 1701 nt, Artificial Sequence; identical to SEQ ID NO: 101506
  derived and/or modified sequence opt2 from hemagglutinin__InfluenzaA__AIL94918

SEQ ID NO: 104188 - RNA, 1701 nt, Artificial Sequence; identical to SEQ ID NO: 101506
  derived and/or modified sequence opt2 from hemagglutinin__InfluenzaA__AIL94930

SEQ ID NO: 104189 - RNA, 1701 nt, Artificial Sequence; identical to SEQ ID NO: 101506
  derived and/or modified sequence opt2 from hemagglutinin__InfluenzaA__AIL94942

SEQ ID NO: 104190 - RNA, 1701 nt, Artificial Sequence; identical to SEQ ID NO: 101552
  derived and/or modified sequence opt2 from hemagglutinin__InfluenzaA__AIL94954

SEQ ID NO: 104191 - RNA, 1701 nt, Artificial Sequence; identical to SEQ ID NO: 101370
  derived and/or modified sequence opt2 from hemagglutinin__InfluenzaA__AIL94965

SEQ ID NO: 104192 - RNA, 1701 nt, Artificial Sequence
  derived and/or modified sequence opt2 from hemagglutinin__InfluenzaA__AIM55837
augaaggccauccucgucguccuccucuacaccuucgccaccgccaccgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcucucccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104193 - RNA, 1701 nt, Artificial Sequence
  derived and/or modified sequence opt2 from hemagglutinin__InfluenzaA__AIM55848
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacaccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104194 - RNA, 1701 nt, Artificial Sequence; identical to SEQ ID NO: 101552
  derived and/or modified sequence opt2 from hemagglutinin__InfluenzaA__AIM55859

SEQ ID NO: 104195 - RNA, 1701 nt, Artificial Sequence; identical to SEQ ID NO: 101552
  derived and/or modified sequence opt2 from hemagglutinin__InfluenzaA__AIM55870

SEQ ID NO: 104196 - RNA, 1701 nt, Artificial Sequence; identical to SEQ ID NO: 101552
  derived and/or modified sequence opt2 from hemagglutinin__InfluenzaA__AIM55881

SEQ ID NO: 104197 - RNA, 1701 nt, Artificial Sequence; identical to SEQ ID NO: 103414
  derived and/or modified sequence opt2 from hemagglutinin__InfluenzaA__AIM55893

SEQ ID NO: 104198 - RNA, 1701 nt, Artificial Sequence; identical to SEQ ID NO: 102533
  derived and/or modified sequence opt2 from hemagglutinin__InfluenzaA__AIM55904

SEQ ID NO: 104199 - RNA, 1701 nt, Artificial Sequence; identical to SEQ ID NO: 101552
  derived and/or modified sequence opt2 from hemagglutinin__InfluenzaA__AIM55915

SEQ ID NO: 104200 - RNA, 1710 nt, Artificial Sequence
  derived and/or modified sequence opt2 from hemagglutinin__InfluenzaA__AIM55926
augaaggccauccucgucguccuccucuacaccuucgccaccaccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccucaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104201 - RNA, 1701 nt, Artificial Sequence; identical to SEQ ID NO: 101552
  derived and/or modified sequence opt2 from hemagglutinin__InfluenzaA__AIM55937

SEQ ID NO: 104202 - RNA, 1701 nt, Artificial Sequence; identical to SEQ ID NO: 102533
  derived and/or modified sequence opt2 from hemagglutinin__InfluenzaA__AIM55948

SEQ ID NO: 104203 - RNA, 1701 nt, Artificial Sequence; identical to SEQ ID NO: 102515
  derived and/or modified sequence opt2 from hemagglutinin__InfluenzaA__AIM55962

SEQ ID NO: 104204 - RNA, 1701 nt, Artificial Sequence; identical to SEQ ID NO: 102533
  derived and/or modified sequence opt2 from hemagglutinin__InfluenzaA__AIM55984

SEQ ID NO: 104205 - RNA, 1701 nt, Artificial Sequence; identical to SEQ ID NO: 103414
  derived and/or modified sequence opt2 from hemagglutinin__InfluenzaA__AIM55995

SEQ ID NO: 104206 - RNA, 1701 nt, Artificial Sequence
  derived and/or modified sequence opt2 from hemagglutinin__InfluenzaA__AIM56017
augaaggccauccucgucguccuccucuacaccuucgccaccaccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggccacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104207 - RNA, 1701 nt, Artificial Sequence; identical to SEQ ID NO: 104206
  derived and/or modified sequence opt2 from hemagglutinin__InfluenzaA__AIM56028

SEQ ID NO: 104208 - RNA, 1701 nt, Artificial Sequence
  derived and/or modified sequence opt2 from hemagglutinin__InfluenzaA__AIM56039
augaaggccauccucgucguccuccucuaccccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgaggccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104209 - RNA, 1701 nt, Artificial Sequence
  derived and/or modified sequence opt2 from hemagglutinin__InfluenzaA__AIM56050
augaaggccauccucgucguccuccucuacaccuucgccaccaccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcggcaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104210 - RNA, 1701 nt, Artificial Sequence; identical to SEQ ID NO: 101552
  derived and/or modified sequence opt2 from hemagglutinin__InfluenzaA__AIM56061

SEQ ID NO: 104211 - RNA, 1701 nt, Artificial Sequence; identical to SEQ ID NO: 101552
  derived and/or modified sequence opt2 from hemagglutinin__InfluenzaA__AIM56072

SEQ ID NO: 104212 - RNA, 1701 nt, Artificial Sequence; identical to SEQ ID NO: 103405
  derived and/or modified sequence opt2 from hemagglutinin__InfluenzaA__AIM56083

SEQ ID NO: 104213 - RNA, 1701 nt, Artificial Sequence; identical to SEQ ID NO: 101552
  derived and/or modified sequence opt2 from hemagglutinin__InfluenzaA__AIM56105

SEQ ID NO: 104214 - RNA, 1701 nt, Artificial Sequence; identical to SEQ ID NO: 101552
  derived and/or modified sequence opt2 from hemagglutinin__InfluenzaA__AIM56116

SEQ ID NO: 104215 - RNA, 1701 nt, Artificial Sequence
  derived and/or modified sequence opt2 from hemagglutinin__InfluenzaA__AIM56127
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaaggccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104216 - RNA, 1701 nt, Artificial Sequence; identical to SEQ ID NO: 101552
  derived and/or modified sequence opt2 from hemagglutinin__InfluenzaA__AIM56138

SEQ ID NO: 104217 - RNA, 1701 nt, Artificial Sequence; identical to SEQ ID NO: 101552
  derived and/or modified sequence opt2 from hemagglutinin__InfluenzaA__AIM56149

SEQ ID NO: 104218 - RNA, 1701 nt, Artificial Sequence; identical to SEQ ID NO: 103405
  derived and/or modified sequence opt2 from hemagglutinin__InfluenzaA__AIM56160

SEQ ID NO: 104219 - RNA, 1701 nt, Artificial Sequence; identical to SEQ ID NO: 101552
  derived and/or modified sequence opt2 from hemagglutinin__InfluenzaA__AIM56171

SEQ ID NO: 104220 - RNA, 1701 nt, Artificial Sequence
  derived and/or modified sequence opt2 from hemagglutinin__InfluenzaA__AIM56182
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaaggccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaacaaggagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104221 - RNA, 1701 nt, Artificial Sequence
  derived and/or modified sequence opt2 from hemagglutinin__InfluenzaA__AIM56193
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaaggucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104222 - RNA, 1701 nt, Artificial Sequence; identical to SEQ ID NO: 101552
  derived and/or modified sequence opt2 from hemagglutinin__InfluenzaA__AIM56204

SEQ ID NO: 104223 - RNA, 1701 nt, Artificial Sequence; identical to SEQ ID NO: 101552
  derived and/or modified sequence opt2 from hemagglutinin__InfluenzaA__AIM56215

SEQ ID NO: 104224 - RNA, 1701 nt, Artificial Sequence; identical to SEQ ID NO: 101552
  derived and/or modified sequence opt2 from hemagglutinin__InfluenzaA__AIM56226

SEQ ID NO: 104225 - RNA, 1701 nt, Artificial Sequence; identical to SEQ ID NO: 103963
  derived and/or modified sequence opt2 from hemagglutinin__InfluenzaA__AIM56237

SEQ ID NO: 104226 - RNA, 1701 nt, Artificial Sequence; identical to SEQ ID NO: 101552
  derived and/or modified sequence opt2 from hemagglutinin__InfluenzaA__AIM56259

SEQ ID NO: 104227 - RNA, 1701 nt, Artificial Sequence
  derived and/or modified sequence opt2 from hemagglutinin__InfluenzaA__AIM56270
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccgucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104228 - RNA, 1701 nt, Artificial Sequence; identical to SEQ ID NO: 101552
  derived and/or modified sequence opt2 from hemagglutinin__InfluenzaA__AIM56281

SEQ ID NO: 104229 - RNA, 1701 nt, Artificial Sequence
  derived and/or modified sequence opt2 from hemagglutinin__InfluenzaA__AIM56292
augaaggccauccucgucguccuccucuacacccucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagauccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104230 - RNA, 1701 nt, Artificial Sequence
  derived and/or modified sequence opt2 from hemagglutinin__InfluenzaA__AIM56303
augaaggccauccucgucguccuccucuacacccucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccagguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104231 - RNA, 1701 nt, Artificial Sequence
  derived and/or modified sequence opt2 from hemagglutinin__InfluenzaA__AIM56314
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaagcucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104232 - RNA, 1701 nt, Artificial Sequence; identical to SEQ ID NO: 101552
  derived and/or modified sequence opt2 from hemagglutinin__InfluenzaA__AIM56325

SEQ ID NO: 104233 - RNA, 1701 nt, Artificial Sequence
  derived and/or modified sequence opt2 from hemagglutinin__InfluenzaA__AIM56336
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagauccgcaaccagcucaagaacaacgccaaggagaucggcaacggcugcuucgaguucuaccacaagugcgacaacaugugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104234 - RNA, 1701 nt, Artificial Sequence
  derived and/or modified sequence opt2 from hemagglutinin__InfluenzaA__AIM56347
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccaccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104235 - RNA, 1701 nt, Artificial Sequence
  derived and/or modified sequence opt2 from hemagglutinin__InfluenzaA__AIM56358
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucaagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104236 - RNA, 1701 nt, Artificial Sequence; identical to SEQ ID NO: 101552
  derived and/or modified sequence opt2 from hemagglutinin__InfluenzaA__AIM56369

SEQ ID NO: 104237 - RNA, 1701 nt, Artificial Sequence
  derived and/or modified sequence opt2 from hemagglutinin__InfluenzaA__AIM56380
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucucccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104238 - RNA, 1701 nt, Artificial Sequence; identical to SEQ ID NO: 101552
  derived and/or modified sequence opt2 from hemagglutinin__InfluenzaA__AIM56391

SEQ ID NO: 104239 - RNA, 1701 nt, Artificial Sequence; identical to SEQ ID NO: 101552
  derived and/or modified sequence opt2 from hemagglutinin__InfluenzaA__AIM56402

SEQ ID NO: 104240 - RNA, 1701 nt, Artificial Sequence; identical to SEQ ID NO: 103405
  derived and/or modified sequence opt2 from hemagglutinin__InfluenzaA__AIM56413

SEQ ID NO: 104241 - RNA, 1701 nt, Artificial Sequence; identical to SEQ ID NO: 101552
  derived and/or modified sequence opt2 from hemagglutinin__InfluenzaA__AIM56425

SEQ ID NO: 104242 - RNA, 1701 nt, Artificial Sequence; identical to SEQ ID NO: 101552
  derived and/or modified sequence opt2 from hemagglutinin__InfluenzaA__AIM56436

SEQ ID NO: 104243 - RNA, 1701 nt, Artificial Sequence; identical to SEQ ID NO: 101552
  derived and/or modified sequence opt2 from hemagglutinin__InfluenzaA__AIM56447

SEQ ID NO: 104244 - RNA, 1701 nt, Artificial Sequence; identical to SEQ ID NO: 101552
  derived and/or modified sequence opt2 from hemagglutinin__InfluenzaA__AIM56469

SEQ ID NO: 104245 - RNA, 1701 nt, Artificial Sequence
  derived and/or modified sequence opt2 from hemagglutinin__InfluenzaA__AIM56480
augaaggccauccucgucguccuccucuacaccuucgccaccaccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucacccucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104246 - RNA, 1701 nt, Artificial Sequence; identical to SEQ ID NO: 101552
  derived and/or modified sequence opt2 from hemagglutinin__InfluenzaA__AIM56491

SEQ ID NO: 104247 - RNA, 1710 nt, Artificial Sequence
  derived and/or modified sequence opt2 from hemagglutinin__InfluenzaA__AIM56502
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaaggccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccucaccucccuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104248 - RNA, 1701 nt, Artificial Sequence; identical to SEQ ID NO: 101552
  derived and/or modified sequence opt2 from hemagglutinin__InfluenzaA__AIM56513

SEQ ID NO: 104249 - RNA, 1701 nt, Artificial Sequence; identical to SEQ ID NO: 103497
  derived and/or modified sequence opt2 from hemagglutinin__InfluenzaA__AIM56524

SEQ ID NO: 104250 - RNA, 1701 nt, Artificial Sequence; identical to SEQ ID NO: 101552
  derived and/or modified sequence opt2 from hemagglutinin__InfluenzaA__AIM56535

SEQ ID NO: 104251 - RNA, 1701 nt, Artificial Sequence; identical to SEQ ID NO: 101552
  derived and/or modified sequence opt2 from hemagglutinin__InfluenzaA__AIM56546

SEQ ID NO: 104252 - RNA, 1701 nt, Artificial Sequence; identical to SEQ ID NO: 103405
  derived and/or modified sequence opt2 from hemagglutinin__InfluenzaA__AIM56557

SEQ ID NO: 104253 - RNA, 1701 nt, Artificial Sequence
  derived and/or modified sequence opt2 from hemagglutinin__InfluenzaA__AIM56568
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuucuccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104254 - RNA, 1701 nt, Artificial Sequence
  derived and/or modified sequence opt2 from hemagglutinin__InfluenzaA__AIM56579
augaaggccauccucgucguccuccucuacaccuucgccaccaccaacgccgacacccucugcaucggcuaccacgccaacaacuccaccgacaccgucgacaccguccucgagaagaacgucaccgucacccacuccgucaaccuccucgaggacgagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacaccgacgccuacgucuucgucggcaccucccgcuacuccaagaaguucaagcccgagaucgccauccgccccaagguccgcgaccaggagggccgcauguccuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104255 - RNA, 1710 nt, Artificial Sequence
  derived and/or modified sequence opt2 from hemagglutinin__InfluenzaA__AIM56590
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccucaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacgacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104256 - RNA, 1710 nt, Artificial Sequence
  derived and/or modified sequence opt2 from hemagglutinin__InfluenzaA__AIM56601
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccucaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104257 - RNA, 1710 nt, Artificial Sequence
  derived and/or modified sequence opt2 from hemagglutinin__InfluenzaA__AIM56612
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacaccggcuccggcaucaucaucuccgacacccccguccacgacugcaacaccaccugccagacccccgagggcgccaucaacaccucccucaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104258 - RNA, 1701 nt, Artificial Sequence
  derived and/or modified sequence opt2 from hemagglutinin__InfluenzaA__AIM56623
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaccuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104259 - RNA, 1701 nt, Artificial Sequence
  derived and/or modified sequence opt2 from hemagglutinin__InfluenzaA__AIM56634
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccaacuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104260 - RNA, 1710 nt, Artificial Sequence
  derived and/or modified sequence opt2 from hemagglutinin__InfluenzaA__AIM56645
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccucaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccagaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104261 - RNA, 1701 nt, Artificial Sequence
  derived and/or modified sequence opt2 from hemagglutinin__InfluenzaA__AIM56656
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccaacuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaacaucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104262 - RNA, 1701 nt, Artificial Sequence; identical to SEQ ID NO: 101552
  derived and/or modified sequence opt2 from hemagglutinin__InfluenzaA__AIM56667

SEQ ID NO: 104263 - RNA, 1701 nt, Artificial Sequence
  derived and/or modified sequence opt2 from hemagglutinin__InfluenzaA__AIM56678
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcguccccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104264 - RNA, 1701 nt, Artificial Sequence; identical to SEQ ID NO: 103900
  derived and/or modified sequence opt2 from hemagglutinin__InfluenzaA__AIM56689

SEQ ID NO: 104265 - RNA, 1701 nt, Artificial Sequence; identical to SEQ ID NO: 101552
  derived and/or modified sequence opt2 from hemagglutinin__InfluenzaA__AIM56700

SEQ ID NO: 104266 - RNA, 1710 nt, Artificial Sequence
  derived and/or modified sequence opt2 from hemagglutinin__InfluenzaA__AIM56711
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcguccccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccucaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104267 - RNA, 1701 nt, Artificial Sequence; identical to SEQ ID NO: 103900
  derived and/or modified sequence opt2 from hemagglutinin__InfluenzaA__AIM56722

SEQ ID NO: 104268 - RNA, 1701 nt, Artificial Sequence; identical to SEQ ID NO: 101552
  derived and/or modified sequence opt2 from hemagglutinin__InfluenzaA__AIM56733

SEQ ID NO: 104269 - RNA, 1701 nt, Artificial Sequence; identical to SEQ ID NO: 101552
  derived and/or modified sequence opt2 from hemagglutinin__InfluenzaA__AIM56744

SEQ ID NO: 104270 - RNA, 1701 nt, Artificial Sequence
  derived and/or modified sequence opt2 from hemagglutinin__InfluenzaA__AIM56755
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccucccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104271 - RNA, 1710 nt, Artificial Sequence; identical to SEQ ID NO: 104256
  derived and/or modified sequence opt2 from hemagglutinin__InfluenzaA__AIM56766

SEQ ID NO: 104272 - RNA, 1701 nt, Artificial Sequence
  derived and/or modified sequence opt2 from hemagglutinin__InfluenzaA__AIM56777
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgagggcaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucaacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucucccaguccuacaucaacgacaagggcaaggagguccucguccucuggggcauccaccaccccuccaccaccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccgagggcgccaucaacaccucccuccccuaccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacaagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcaaccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgagaagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104273 - RNA, 1701 nt, Artificial Sequence; identical to SEQ ID NO: 101552
  derived and/or modified sequence opt2 from hemagglutinin__InfluenzaA__AIM56788

SEQ ID NO: 104274 - RNA, 1701 nt, Artificial Sequence; identical to SEQ ID NO: 101552
  derived and/or modified sequence opt2 from hemagglutinin__InfluenzaA__AIM56799

SEQ ID NO: 104275 - RNA, 1701 nt, Artificial Sequence; identical to SEQ ID NO: 101552
  derived and/or modified sequence opt2 from hemagglutinin__InfluenzaA__AIM56810

SEQ ID NO: 104276 - RNA, 1701 nt, Artificial Sequence; identical to SEQ ID NO: 101552
  derived and/or modified sequence opt2 from hemagglutinin__InfluenzaA__AIM56821

SEQ ID NO: 104277 - RNA, 1683 nt, Artificial Sequence
  derived and/or modified sequence opt2 from hemagglutinin__InfluenzaA__AIN76383
augaacacccagauccucgucuucgcccucaucgccaucguccccaccaacgccgacaagaucugccucggccaccacgccgucuccaacggcaccaaggucaacacccucaccgagcgcggcgucgaggucgucaacgccaccgagaccgucgagcgcaccaacaucccccgcaucugcuccaagggcaagaagaccgucgaccucggccagugcggccuccucggcaccaucaccggccccccccagugcgaccaguuccucgaguucuccgccgaccucaucaucgagcgccgcgagggcuccgacgucugcuaccccggcaaguucgucaacgaggaggcccuccgccagauccuccgcgaguccggcggcaucgacaaggaggccaugggcuucaccuacuccggcauccgcaccaacggcaccaccuccgccugccgccgcuccggcuccuccuucuacgccgagaugaaguggcuccucuccaacaccgacaacgccgccuucccccagaugaccaaguccuacaagaacacccgcaagucccccgcccucaucgucuggggcauccaccacuccgucuccaccgccgagcagaccaagcucuacggcuccggcaacaagcucgucaccgucggcuccuccaacuaccagcaguccuucguccccucccccggcgcccgcccccaggucaacggccucuccggccgcaucgacuuccacuggcucaugcucaaccccaacgacaccgucaccuucuccuucaacggcgccuucaucgcccccgaccgcgccuccuuccuccgcggcaaguccaugggcauccaguccggcguccaggucgacgccaacugcgagggcgacugcuaccacuccggcggcaccaucaucuccaaccuccccuuccagaacaucgacucccgcgccgucggcaagugcccccgcuacgucaagcagaagucccuccuccucgccaccggcaugaagaacguccccgagauccccaagggccgcggccucuucggcgccaucgccggcuucaucgagaacggcugggagggccucaucgacggcugguacggcuuccgccaccagaacgcccagggcgagggcaccgccgccgacuacaaguccacccaguccgccaucgaccagaucaccggcaagcucaaccgccucaucgagaagaccaaccagcaguucgagcucaucgacaacgaguucaacgaggucgagaagcagaucggcaacgucaucaacuggacccgcgacuccaucaccgaggucugguccuacaacgccgagcuccucgucgccauggagaaccagcacaccaucgaccucgccgacuccgagauggacaagcucuacgagcgcgucaagcgccagcuccgcgagaacgccgaggaggacggcaccggcugcuucgagaucuuccacaagugcgacgacgacugcauggccuccauccgcaacaacaccuacgaccacuccaaguaccgcgaggaggccaugcagaaccgcauccagaucgaccccgucaagcucuccuccggcuacaaggacgucauccucugguucuccuucggcgccuccugcuucauccuccucgccaucgucaugggccucgucuucaucugcgucaagaacggcaacaugcgcugcaccaucugcaucuga

SEQ ID NO: 104278 - RNA, 1689 nt, Artificial Sequence
  derived and/or modified sequence opt2 from hemagglutinin__InfluenzaA__AIP93103
auggccaucaucuaccucauccuccucuucaccgccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccuccgcguccccgagugguccuacaucauggagaaggagaacccccgcuacucccucugcuaccccggcuccuucaacgacuacgaggagcucaagcaccuccucuccuccgucaagcacuucgagaaggucaagauccuccccaaggacggcuggacccagcacgagaccgacggcggcuccaaggccugcgccgucuccggcaagcccuccuucuuccgcaacauggucuggcucaccaagaagggccccaacuaccccgucgccaagcgcuccuacaacaacaccuccggcgagcagaugcucaucaucuggggcguccaccaccccaacgacgaggccgagcagcgcgcccucuaccagaacgucggcaccuacgucuccgccuccaccuccacccucaacaagcgcuccacccccgagaucgccgcccgccccaaggucuccggccucggcucccgcauggaguucuccuggacccuccucgacgucugggacaccaucuccuucgaguccaccggcaaccucgucgcccccgaguacggcuucaagaucuccaagcgcggcuccuccggcaucaugaagaccgagggcacccucggcaacugcgagaccaagugccagaccccccucggcgccaucaacaccacccuccccuuccacaacguccacccccucaccaucggcgagugccccaaguacgucaaguccgagaagcucguccucgccaccggcccccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgaccgcaucaccaacaaggucaacuccgucaucgagaagaugaacacccaguucgaggccgucggcaaggaguucuccaaccucgagaagcgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacgacgagugcaugaacuccgucaagaacggcaccuacgacuaccccaaguacgaggaggaguccaagcucaagcgcaacgagaucaagggcgucaagcucuccuccaugggcgucuaccagauccucgccaucuacgccaccgucgccggcucccucucccucgccaucaugaucgccggcaucuccuucuggaugugcuccaacggcucccuccagugccgcaucugcaucuga

SEQ ID NO: 104279 - RNA, 1689 nt, Artificial Sequence; identical to SEQ ID NO: 93167
  derived and/or modified sequence opt2 from hemagglutinin__InfluenzaA__AIP93115

SEQ ID NO: 104280 - RNA, 1701 nt, Artificial Sequence
  derived and/or modified sequence opt2 from hemagglutinin__InfluenzaA__AIR93971
augaaggccauccucgucguccuccucuacaccuucgccaccaccaacgccgacauccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgcccgcuccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccgcgagggccgcaugaacuacuacuggacccucgucgagcccggcgacaagaucaccuucgaggccaccggcaaccucgucgucccccgcuacgccuucgccauggagcgcaacgccggcuccggcaucaucaccuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104281 - RNA, 1701 nt, Artificial Sequence
  derived and/or modified sequence opt2 from hemagglutinin__InfluenzaA__AIR93982
augaaggccauccucgucguccuccucuacaccaucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgcccgcuccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccgcgagggccgcaugaacuacuacuggacccucgucgagcccggcgacaagaucaccuucgaggccaccggcaaccucgucgucccccgcuacgccuucaccauggagcgcaacgccggcuccggcaucaucaucuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaccaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104282 - RNA, 1701 nt, Artificial Sequence
  derived and/or modified sequence opt2 from hemagglutinin__InfluenzaA__AIR93993
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcucaagggcgucgccccccuccaccucggcaagugcaacaucgccggcuggauccucggcaaccccgagugcggcucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugccccaacgccggcuccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcggccaggagggccgcauggacuacuacuggacccucgucgagcccggcgacaagaucaccuucgaggccaccggcaaccucgucgucccccgcuacgccuucgccauggagcgcaacaccggcuccggcaucaucaucuccgacacccccguccacgacugcaacaccaucugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaagggcugcuucgaguucuaccacaagugcgacaccaugugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104283 - RNA, 1701 nt, Artificial Sequence
  derived and/or modified sequence opt2 from hemagglutinin__InfluenzaA__AIR94000
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccuccuuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaccaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104284 - RNA, 1683 nt, Artificial Sequence
  derived and/or modified sequence opt2 from hemagglutinin__InfluenzaA__AIR94116
auggagaccgccucccucaucaccauccuccucgucgucaccgucuccaacgccgacaagaucugcaucggcuaccaguccaccaacuccaccgagaccgucgacacccucaccgagaacaacguccccgucacccacgccaaggagcuccuccacaccgagcacaacggcaugcucugcgccaccucccucggccacccccucauccucgacaccugcaccaucgagggccucaucuacggcaaccccuccugcgaccuccuccucggcggccgcgagugguccuacaucgucgagcgccccuccgccgucaacggccucugcuaccccggcaacgucgagaaccucgaggagcuccgcucccucuucuccuccgcccgcuccuaccagcgcauccagaucuuccccgacaccaucuggaacgucuccuacuccggcaccuccaaggccugcuccgacuccuucuaccgcuccaugcgcuggcucacccagaaggacaacgccuaccccauccaggacgcccaguacaccaacaaccagggcaagaacauccucuucauguggggcaucaaccacccccccaccgacaccgcccagaccaaccucuacacccgcaccgacaccaccaccuccgucgccaccgaggagaucaaccgcaccuucaagccccucaucggcccccgcccccucgucaacggccucaugggccgcaucaacuacuacugguccguccucaagcccggccagacccuccgcaucaaguccaacggcaaccucaucgcccccugguacggccacauccucuccggcgagucccacggccgcauccucaagaccgaccucaagcgcggcuccugcaccguccagugccagaccgagaagggcggccucaacaccacccuccccuuccagaacgucuccaaguacgccuucggcaacugcuccaaguacaucggcaucaagucccucaagcucgccgucggccuccgcaacguccccucccgcuccucccgcggccucuucggcgccaucgccggcuucaucgagggcggcugguccggccucgucgccggcugguacggcuuccagcacuccaacgaccagggcgucggcauggccgccgaccgcgacuccacccagaaggccaucgacaagaucaccuccaaggucaacaacaucgucgacaagaugaacaagcaguacgagaucaucgaccacgaguucaacgaggucgagacccgccucaacaugaucaacaacaagaucgacgaccagauccaggacaucugggccuacaacgccgagcuccucguccuccucgagaaccagaagacccucgacgagcacgacgccaacgucaacaaccucuacaacaaggucaagcgcgcccucggcuccaacgccgucgaggacggcaagggcugcuucgagcucuaccacaagugcgacgaccagugcauggagaccauccgcaacggcaccuacaaccgccgcaaguaccaggaggaguccaagcucgagcgccagaagaucgagggcgucaagcucgaguccgagggcaccuacaagauccucaccaucuacuccaccgucgccuccucccucgucaucgccaugggcuucgccgccuuccucuucugggccauguccaacggcuccugccgcugcaacaucugcaucuga

SEQ ID NO: 104285 - RNA, 1701 nt, Artificial Sequence
  derived and/or modified sequence opt2 from hemagglutinin__InfluenzaA__AIT38333
augaagaccaucaucacccucuccuacauccucugccacgucuucgcccagaagauccacggcuccgacuccuccaccgccacccucugccucggccaccacgccguccccaacggcacccucgucaagaccaucaccaacgaccagaucgaggucaccaacgccaccgagcucguccaguccuccuccaccggccgcaucugcgacaacccccaccgcauccucgacggcaagaacugcacccucaucgacgcccuccucggcgacccccacugcgacgaguuccagaacaaggagugggaccucuucgucgagcgcuccaacgccuacuccgacugcuaccccuacuacguccccgacuacgccucccuccgcucccucgucgccuccuccggcacccucgaguucaacaacgaguccuucaacuggaccggcaucucccaggacggcaccuccuccuccugccgccgcggcuccgucaaguccuucuucucccgccucaacuggcuccacggccucgaguacaaguaccccgcccagaacgucaccaugcucaacaacgacgaguucgacaagcucuacaucuggggcguccaccaccccuccaccgacuccgaccagaccucccucuacguccagaccuccggccgcgucaccgucuccaccaagcgcucccagcagaccgucauccccaacaucggcucccgccccuggguccgcggcaucuccucccgcaucuccauccacuggaccaucgucaagcccggcgacauccuccucaucaacuccaccggcaaccucaucgccccccgcggcuacuucaagauccgcggcggcaaguccuccaucaugcgcuccgacgcccccaucgacaacugcgacuccgagugcgucacccccaacggcaacauccccaacgacaagcccuuccagaacgucaaccgcaucaccuacggccccugcccccgcuacaucaagcagaacacccucaagcucgccaccggcaugcgcaacguccccgagaagcagacccgcggcguccucggcgccaucgccggcuucaucgagaacggcugggagggcauggucgacggcugguacggcuuccgccaccagaacuccgagggcaccggccaggccgccgaccucaaguccacccaggccgccaucgaccagaucaacggcaagcucaaccgccucaucggcaagaccaacgagaaguuccaccagaucgagaaggaguucuccgagaucgagggccgcguccaggaccucgagaaguacgucgaggacaccaagaucgaccucugguccuacaacgccgagcuccucgucguccucgagaaccagcacaccaucgaccucaccgacuccgagaugaacaagcucuucgagcgcacccgccgccagcuccgcgagaacgccgaggacaugggcaacggcugcuucaagaucuaccacaagugcgacaacgccugcaucggcuccauccgcaacggcaccuacguccacgacgucuaccgcgacgaggcccucaacaaccgcuuccagaucaagggcgucgagcucaaguccggcuacaaggacuggauccucuggaucuccuucgccaucuccugcuuccuccucugcgccguccuccucggcuucaucaccugggccugccagaagggcaacauccgcugcaacaucugcaucuga

SEQ ID NO: 104286 - RNA, 1698 nt, Artificial Sequence
  derived and/or modified sequence opt2 from hemagglutinin__InfluenzaA__AIT38344
augaagaucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccuccgcggcaucgccccccuccagcucggcaacugcuccgucgccggcuggauccucggcaaccccgagugcgagucccucaucuccaaggaguccugguccuacaucgucgagaagcccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcuccuacaacggcaagggcaacuucuacaagaaccuccucuggcucacccgcaagaacggccucuaccccaaccucuccaaguccuacaccaacaacaaggagaaggagguccucauccucuggggcguccaccaccccuccaacaucaaggaccagcgcacccucuaccacaccgagaacgccuacgucuccgucgucuccucccacuacucccgccgcuucacccccgagaucaccaagcgccccaagguccgcgaccaggagggccgcaucaacuacuacuggacccuccucgagcccggcgacaccaucaucuucgaggccaacggcaaccucaucgcccccugguacgccuucgcccucucccgcggcuucggcuccggcaucaucaccuccaacgcccccauggacgagugcgaggccaagugccagaccccccgcggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgacaaggaguccacccagaacgccaucaacggcaucaccaacaaggucaacuccgucaucgagaagaugaacacccaguucaccaccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagauccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 104287 - RNA, 1698 nt, Artificial Sequence
  derived and/or modified sequence opt2 from hemagglutinin__InfluenzaA__AIT38360
augaagaucaagcuccucauccuccucugcaccuucaccgccaccuacgccgacaccaucugcaucggcuaccacgccaacaacuccaccgacaccgucgacaccguccucgagaagaacgucaccgucacccacuccgucaaccuccucgaggacucccacaacggcaagcucugccuccucaagggcaucgccccccuccagcucggcaacugcuccgucgccggcuggauccucggcaaccccgagugcgagucccucaucuccaaggaguccugguccuacaucgucgagaagcccaaccccgagaacggcaccugcuaccccggcuacuucgccgacuacgaggagcuccgcgagcagcucuccuccgucuccuccuucgagcgcuucgagaucuuccccaaggaguccuccuggcccaaccacaccgucaccggcgucuccgccuccugcuccuacaacggcaagggcaacuucuacaagaaccuccucuggcucacccgcaagaacggccucuaccccaaccucuccaaguccuacaccaacaacaaggagaaggagguccucauccucuggggcguccaccaccccuccaacaucgaggaccagcgcacccucuaccacaccgagaacgccuacgucuccgucgucuccucccacuacucccgccgcuucacccccgagaucaccaagcgccccaagguccgcggccaggagggccgcaucaacuacuacuggacccuccucgagcccggcgacaccaucaucuucgaggccaacggcaaccucaucgcccccugguacgccuucgcccucucccgcggccucggcuccggcaucaucaccuccaacgcccccauggacgagugcgaggccaagugccagaccccccgcggcgccaucaacuccucccuccccuuccagaacguccaccccgucaccaucggcgagugccccaaguacguccgcuccgccaagcuccgcauggucaccggccuccgcaacauccccuccauccagucccgcggccucuucggcgccaucgccggcuucaucgagggcggcuggaccggcaugaucgacggcugguacggcuaccaccaccagaacgagcagggcuccggcuacgccgccgacaaggaguccacccagaacgccaucaacggcaucaccaacaaggucaacuccgucaucgagaagaugaacacccaguucaccaccgucggcaaggaguucaacaagcucgagcgccgcauggagaaccucaacaagaaggucgacgacggcuuccucgacaucuggaccuacaacgccgagcuccucguccuccucgagaacgagcgcacccucgacuuccacgacuccaacgucaagaaccucuacgagaaggucaagucccagcucaagaacaacgccaaggagaucggcaacggcugcuucgaguucuaccacaagugcaacaacgagugcauggaguccgucaagaacggcaccuacgacuaccccaaguacuccgaggaguccaagcucaaccgcgagaagaucgacggcgucaagcucgaguccaugggcgucuaccagauccucgccaucuacuccaccgucgccuccucccucguccuccucgucucccucggcgccaucuccuucuggaugugcuccaacggcucccuccagugccgcaucugcaucuga

SEQ ID NO: 104288 - RNA, 1701 nt, Artificial Sequence; identical to SEQ ID NO: 101552
  derived and/or modified sequence opt2 from hemagglutinin__InfluenzaA__AIT93147

SEQ ID NO: 104289 - RNA, 1701 nt, Artificial Sequence; identical to SEQ ID NO: 94181
  derived and/or modified sequence opt2 from hemagglutinin__InfluenzaA__AIU39700

SEQ ID NO: 104290 - RNA, 1701 nt, Artificial Sequence
  derived and/or modified sequence opt2 from hemagglutinin__InfluenzaA__AIU39702
augaaggccauccucgucguccuccucuacaccuucgccaccgccaacgccgacacccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagucccucuccaccgccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccaaccacgacuccaacaagggcgucaccgccgccugcccccacgccggcgccaaguccuucuacaagaaccucaucuggcucgucaagaagggcaacuccuaccccaagcucuccaaguccuacaucaacgacaagggcaaggagguccucguccucuggggcauccaccaccccuccaccuccgccgaccagcagucccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaucuccgacacccccguccacgacugcaacaccaccugccagacccccaagggcgccaucaacaccuccuuccccuuccagaacauccaccccaucaccaucggcaagugccccaaguacgucaaguccaccaagcuccgccucgccaccggccuccgcaacauccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgagaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104291 - RNA, 1701 nt, Artificial Sequence; identical to SEQ ID NO: 98421
  derived and/or modified sequence opt2 from hemagglutinin__InfluenzaA__AIU39704

SEQ ID NO: 104292 - RNA, 1704 nt, Artificial Sequence
  derived and/or modified sequence opt2 from hemagglutinin__InfluenzaA__AIU46609
auggagaagaucguccuccuccucgccaucgucucccucgucaaguccgaccagaucugcaucggcuaccacgccaacaacuccaccgagcaggucgacaccaucauggagaagaacgucaccgucacccacgcccaggacauccucgagaagacccacaacggcaagcucugcgaccucaacggcgucaagccccucauccucaaggacugcuccgucgccggcuggcuccucggcaaccccaugugcgacgaguucauccgcguccccgagugguccuacaucgucgagcgcgccaaccccgccaacgaccucugcuaccccggcaaccucaacgacuacgaggagcucaagcaccuccucucccgcaucaaccacuucgagaagauccucaucauccccaaguccuccuggaccaaccacgagaccucccucggcgucuccgccgccugccccuaccagggcacccccuccuucuuccgcaacgucgucuggcucaucaagaagaacgacgccuaccccaccaucaagaucuccuacaacaacaccaaccaggaggaccuccucauccucuggggcauccaccacuccaacaacgccgccgagcagaccaaccucuacaagaaccccaccaccuacaucuccgucggcaccuccacccucaaccagcgccucguccccaagaucgccacccgcucccaggucaacggccagcgcggccgcauggacuucuucuggaccauccucaagcccaacgacgccauccacuucgaguccaacggcaacuucaucgcccccgaguacgccuacaagaucgucaagaagggcgacuccaccaucaugaaguccgaggucgaguacggccacugcaacaccaagugccagacccccaucggcgccaucaacuccuccaugcccuuccacaacauccacccccucaccaucggcgagugccccaaguacgucaaguccaacaagcucguccucgccaccggccuccgcaacuccccccuccgcgagaagcgccgcaagcgcggccucuucggcgccaucgccggcuucaucgagggcggcuggcagggcauggucgacggcugguacggcuaccaccacuccaacgagcagggcuccggcuacgccgccgacaaggaguccacccagaaggccaucgacggcgucaccaacaaggucaacuccaucaucgacaagaugaacacccaguucgaggccgucggccgcgaguucaacaaccucgagcgccgcaucgagaaccucaacaagaagauggaggacggcuuccucgacgucuggaccuacaacgccgagcuccucguccucauggagaacgagcgcacccucgacuuccacgacuccaacgucaagaaccucuacgacaagguccgccuccagcuccgcgacaacgccaaggagcucggcaacggcugcuucgaguucuaccacaagugcgacaacgagugcauggaguccguccgcaacggcaccuacgacuacccccaguacuccgaggaggcccgccucaagcgcgaggagaucuccggcgucaagcucgaguccaucggcaccuaccagauccucuccaucuacuccaccgucgccuccucccucgcccucgccaucaucgucgccggccucucccucuggaugugcuccaacggcucccuccagugccgcaucugcaucuga

SEQ ID NO: 104293 - RNA, 1689 nt, Artificial Sequence
  derived and/or modified sequence opt2 from hemagglutinin__InfluenzaA__AIU46714
auggccaucaucuaccucauccuccucuucaccgccguccgcggcgaccagaucugcaucggcuaccacgccaacaacuccaccgagaaggucgacaccauccucgagcgcaacgucaccgucacccacgccaaggacauccucgagaagacccacaacggcaagcucugcaagcucaacggcauccccccccucgagcucggcgacugcuccaucgccggcuggcuccucggcaaccccgagugcgaccgccuccuccgcguccccgagugguccuacaucauggagaaggagaaccccaaguacucccucugcuaccccggcuccuucaacgacuacgaggagcucaagcaccuccucuccuccgucaagcacuucgagaaggucaagauccuccccaaggacggcuggacccagcacaagaccgacggcggcuccaaggccugcgccgucuccggcaagcaguccuucuuccgcaacauggucuggcucaccaagaagggccagaacuaccccgucgccaagcgcuccuacaacaacaccuccggcgagcagaugcucaucaucuggggcguccaccaccccaacgacgaggaggagcagcgcgcccucuaccagaaggucggcaccuacgucuccgccuccaccuccacccucaacaagcgcuccacccccgagaucgccgcccgccccgaggucaacggccucggcucccgcauggaguucuccuggacccuccucgacgucugggacaccaucaacuucgaguccaccggcaaccucgucgcccccgaguacggcuucaagaucuccaagcgcggcuccuccggcaucaucaagaccgagggcacccucggcaacugcgagaccaagugccagaccccccucggcgccaucaacaccacccuccccuuccacaacguccacccccucaccaucggcgagugccccaaguacgucaaguccgagaagcucguccucgccaccggccuccgcaacgucccccagaucgagucccgcggccucuucggcgccaucgccggcuucaucgagggcggcuggcagggcauggucgacggcugguacggcuaccaccacuccaacgaccagggcuccggcuacgccgccgacaaggaguccacccagaaggccuucgaccgcaucaccaacaaggucaacuccgucaucgagaagaugaacacccaguucgaggccgucggcaaggaguucuccaaccucgagcgccgccucgagaaccucaacaagaagauggaggacggcuuccucgacgucuggaccuacaacgccgagcuccucguccucauggagaacgagcgcacccucgacuuccacgacuccaacgucaagaaccucuacgacaagguccgcaugcagcuccgcgacaacgucaaggagcucggcaacggcugcuucgaguucuaccacaagugcgacaacgagugcaugaacuccgucaagaacggcaccuacgacuaccccaaguacgaggaggaguccaagcucaagcgcaacgagaucaagggcgucaagcucuccuccaugggcgucuaccagauccucgccaucuacgccaccgucgccggcucccucucccucgccaucaugaucgccggcaucuccuucuggaugugcuccaacggcucccuccagugccgcaucugcaucuga

SEQ ID NO: 104294 - RNA, 1701 nt, Artificial Sequence
  derived and/or modified sequence opt2 from hemagglutinin__InfluenzaA__AIV09219
augaaggccauccucgucguccuccucuacaccuucgccaccaccaacgccgacauccucugcaucggcuaccacgccaacaacuccaccgacaccgucgacaccguccucgagaagaacgucaccgucacccacuccgucaaccuccucgaggacaagcacaacggcaagcucugcaagcuccgcggcgucgccccccuccaccucggcaagugcaacaucgccggcuggauccucggcaaccccgagugcgagcuccucuccaccaccuccuccugguccuacaucgucgagaccuccuccuccgacaacggcaccugcuaccccggcgacuucaucgacuacgaggagcuccgcgagcagcucuccuccgucuccuccuucgagcgcuucgagaucuuccccaagaccuccuccuggcccgaccacgacuccaacaagggcgucaccgccgccugcccccacgccggcgccggcuccuucuacaagaaccucaucuggcucgucaagaagggcaacuccuaccccaagcucuccaaguccuacaucaacgacaagggcaaggagguccucguccucuggggcauccaccacccccccaccuccgccgaccagcagcgccucuaccagaacgccgacgccuacgucuucgucggcaccucccgcuacuccaagaaguucaagcccgagaucgccauccgccccaagguccgcgaccaggagggccgcaugaacuacuacuggacccucgucgagcccggcgacaagaucaccuucgaggccaccggcaaccucgucgucccccgcuacgccuucgccauggagcgcaacgccggcuccggcaucaucaccuccgacacccccguccacgacugcaacaccaccugccagacccccaagggcgccaucaacaccucccuccccuuccagaacauccaccccaucaccaucggcaagugccccaaguacgucaaguccaccaagcuccgccucgccaccggccuccgcaacguccccuccauccagucccgcggccucuucggcgccaucgccggcuucaucgagggcggcuggaccggcauggucgacggcugguacggcuaccaccaccagaacgagcagggcuccggcuacgccgccgaccucaaguccacccagaacgccaucgacgagaucaccaacaaggucaacuccgucaucgacaagaugaacacccaguucaccgccgucggcaaggaguucaaccaccucgagaagcgcaucgagaaccucaacaagaaggucgacgacggcuuccucgacaucuggaccuacaacgccgagcuccucguccuccucgagaacgagcgcacccucgacuaccacgacuccaacgucaagaaccucuacgagaagguccgcucccagcucaagaacaacgccaaggagaucggcaacggcugcuucgaguucuaccacaagugcgacaacaccugcauggaguccgucaagaacggcaccuacgacuaccccaaguacuccgaggaggccaagcucaaccgcgaggagaucgacggcgucaagcucgaguccacccgcaucuaccagauccucgccaucuacuccaccgucgccuccucccucguccucgucgucucccucggcgccaucuccuucuggaugugcuccaacggcucccuccagugccgcaucugcaucuga

SEQ ID NO: 104295 - RNA, 1701 nt, Artificial Sequence
  derived and/or modified sequence opt2 from hemagglutinin__InfluenzaA__AIW60689
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccgacugcuaccccuacgacguccccgacuacgccucccuccgcucccucgucgccuccuccggcacccucgaguucaccaacgagggcuucaacuggaccggcgucgcccaggacggcaccuccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccuccaucuacguccaggccuccggccgcgucaccgucuccaccaagcgcucccagcagaccgucauccccaacaucggcucccgccccuggguccgcggcaucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuacgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgccuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga

SEQ ID NO: 104296 - RNA, 1701 nt, Artificial Sequence
  derived and/or modified sequence opt2 from hemagglutinin__InfluenzaA__AIW60690
augaagaccaucaucgcccucuccuacauccucugccucgucuucgcccagaagcuccccggcaacgacaacuccaccgccacccucugccucggccaccacgccguccccaacggcacccucgucaagaccaucaccaacgaccagaucgaggucaccaacgccaccgagcucguccaguccuccuccaccggccgcaucugcgacuccccccaccgcauccucgacggcaagaacugcacccucaucgacgcccuccucggcgacccccacugcgacggcuuccagaacaaggagugggaccucuucgucgagcgcuccaaggccuacuccgacugcuaccccuacgacguccccgacuacgccucccuccgcucccucgucgccuccuccggcacccucgaguucaccaacgagggcuucaacuggaccggcgucgcccaggacggcaccuccuacgccugcaagcgcggcuccgucaaguccuucuucucccgccucaacuggcuccacaagcucgaguacaaguaccccgcccucaacgucaccaugcccaacaacgacaaguucgacaagcucuacaucuggggcguccaccaccccuccaccgacuccgaccagaccucccucuacguccaggccuccggccgcgucaccgucuccaccaagcgcucccagcagaccgucauccccaacaucggcucccgccccuggguccgcggcgucuccucccgcaucuccaucuacuggaccaucgucaagcccggcgacauccuccucaucaacuccaccggcaaccucaucgccccccgcggcuacuucaagauccgcuccggcaaguccuccaucaugcgcuccgacgcccccaucggcaacugcaacuccgagugcaucacccccaacggcuccauccccaacgacaagcccuuccagaacgucaaccgcaucaccuacggcgccugcccccgcuacgucaagcagaacacccucaagcucgccaccggcaugcgcaacguccccgagaagcagacccgcggcaucuucggcgccaucgccggcuucaucgagaacggcugggagggcauggucgacggcugguacggcuuccgccaccagaacuacgagggcaccggccaggccgccgaccucaaguccacccaggccgccaucaaccagaucaacggcaagcucaaccgccucaucgagaagaccaacgagaaguuccaccagaucgagaaggaguucuccgaggucgagggccgcauccaggaccucgagaaguacgucgaggacaccaagaucgaccucugguccuacaacgccgagcuccucgucgcccucgagaaccagcacaccaucgaccucaccgacuccgagaugaacaagcucuucgagcgcacccgcaagcagcuccgcgagaacgccgaggacaugggcaacggcugcuucaagaucuaccacaagugcgacaacgccugcaucggcuccauccgcaacggcaccuacgaccacgacgccuaccgcgacgaggcccucaacaaccgcuuccagaucaagggcgucgagcucaaguccggcuacaaggacuggauccucuggaucuccuucgccaucuccugcuuccuccucugcgucguccuccucggcuucaucaugugggccugccagaagggcaacauccgcugcaacaucugcaucuga
